(12) United States Patent
Bowen et al.

(10) Patent No.: US 12,398,384 B2
(45) Date of Patent: Aug. 26, 2025

(54) DNA MODIFYING ENZYMES AND ACTIVE FRAGMENTS AND VARIANTS THEREOF AND METHODS OF USE

(71) Applicant: Life Edit Therapeutics, Inc., Durham, NC (US)

(72) Inventors: Tyson D. Bowen, Morrisville, NC (US); Alexandra Briner Crawley, Cary, NC (US); Tedd D. Elich, Durham, NC (US)

(73) Assignee: Life Edit Therapeutics, Inc., Durham, NC (US)

( * ) Notice: Subject to any disclaimer, the term of this patent is extended or adjusted under 35 U.S.C. 154(b) by 440 days.

(21) Appl. No.: 17/851,880

(22) Filed: Jun. 28, 2022

(65) Prior Publication Data
US 2022/0348894 A1    Nov. 3, 2022

Related U.S. Application Data

(63) Continuation of application No. PCT/US2021/049853, filed on Sep. 10, 2021.

(60) Provisional application No. 63/146,840, filed on Feb. 8, 2021, provisional application No. 63/077,089, filed on Sep. 11, 2020.

(51) Int. Cl.
*C12N 9/22* (2006.01)
*C12N 15/63* (2006.01)

(52) U.S. Cl.
CPC .............. *C12N 9/22* (2013.01); *C12N 15/63* (2013.01); *C12N 2310/20* (2017.05); *C12N 2800/80* (2013.01)

(58) Field of Classification Search
CPC ...... C12N 9/22; C12N 15/63; C12N 2310/20; C12N 2800/80; C12N 9/78; C12N 15/52; C12N 15/62; C12N 9/80; C12N 15/102; C12N 15/113; C12Y 305/04002; C12Y 305/01004; C07K 2319/81; C07K 2319/85; A61K 48/00
See application file for complete search history.

(56) References Cited

FOREIGN PATENT DOCUMENTS

CA    3 125 175 A1    7/2020

OTHER PUBLICATIONS

Database Uniprot, A0A0H3CQ57, "Full-tRNA-specific adenosine deaminase," 2015, 1 page.
Database Uniprot, A0A4R0HT86, "Full=tRNA-specific adenosine deaminase," 2019, 1 page.

*Primary Examiner* — Delia M Ramirez
(74) *Attorney, Agent, or Firm* — Womble Bond Dickinson (US) LLP

(57) ABSTRACT

Compositions and methods comprising novel deaminase polypeptides for targeted editing of nucleic acids are provided. Compositions comprise deaminase polypeptides. Also provided are fusion proteins comprising a DNA-binding polypeptide and a deaminase of the invention. The fusion proteins include RNA-guided nucleases fused to deaminases, optionally in complex with guide RNAs. Compositions also include nucleic acid molecules encoding the deaminases or the fusion proteins. Vectors and host cells comprising the nucleic acid molecules encoding the deaminases or the fusion proteins are also provided.

16 Claims, No Drawings
Specification includes a Sequence Listing.

DNA MODIFYING ENZYMES AND ACTIVE FRAGMENTS AND VARIANTS THEREOF AND METHODS OF USE

CROSS-REFERENCE TO RELATED APPLICATIONS

This application is a continuation of International Application No. PCT/US2021/049853, filed Sep. 10, 2021, which claims priority to U.S. Provisional Application Nos. 63/077,089, filed Sep. 11, 2020, and 63/146,840, filed Feb. 8, 2021, each of which is incorporated by reference herein in its entirety.

STATEMENT REGARDING THE SEQUENCE LISTING

The Sequence Listing associated with this application is provided in ASCII format in lieu of a paper copy, and is hereby incorporated by reference into the specification. The ASCII copy named L103438_1230WO_0108_1_SL.txt is 1,071,246 bytes in size, was created on Sep. 9, 2021, and is being submitted electronically via EFS-Web.

FIELD OF THE INVENTION

The present invention relates to the field of molecular biology and gene editing.

BACKGROUND OF THE INVENTION

Targeted genome editing or modification is rapidly becoming an important tool for basic and applied research. Initial methods involved engineering nucleases such as meganucleases, zinc finger fusion proteins or TALENs, requiring the generation of chimeric nucleases with engineered, programmable, sequence-specific DNA-binding domains specific for each particular target sequence. RNA-guided nucleases (RGNs), such as the Clustered Regularly Interspaced Short Palindromic Repeats (CRISPR)-associated (Cas) proteins of the CRISPR-Cas bacterial system, allow for the targeting of specific sequences by complexing the nucleases with guide RNA that specifically hybridizes with a particular target sequence. Producing target-specific guide RNAs is less costly and more efficient than generating chimeric nucleases for each target sequence. Such RNA-guided nucleases can be used to edit genomes through the introduction of a sequence-specific, double-stranded break that is repaired via error-prone non-homologous end-joining (NHEJ) to introduce a mutation at a specific genomic location.

Additionally, RGNs are useful for targeted DNA editing approaches. Targeted editing of nucleic acid sequences, for example targeted cleavage, to allow for introduction of a specific modification into genomic DNA, enables a highly nuanced approach to studying gene function and gene expression. RGNs may also be used to generate chimeric proteins which use the RNA-guided activity of the RGN in combination with a DNA modifying enzyme, such as a deaminase, for targeted base editing. Targeted editing may be deployed for targeting genetic diseases in humans or for introducing agronomically beneficial mutations in the genomes of crop plants. The development of genome editing tools provides new approaches to gene editing-based mammalian therapeutics and agrobiotechnology.

BRIEF SUMMARY OF THE INVENTION

Compositions and methods for modifying a target DNA molecule are provided. The compositions find use in modifying a target DNA molecule of interest. Compositions provided comprise deaminase polypeptides. Also provided are fusion proteins comprising a nucleic acid molecule-binding polypeptide (e.g., DNA-binding polypeptide) and a deaminase polypeptide, and ribonucleoprotein complexes comprising a fusion protein comprising an RNA-guided nuclease and a deaminase polypeptide and ribonucleic acids. Compositions provided also include nucleic acid molecules encoding the deaminase polypeptides or the fusion proteins, and vectors and host cells comprising the nucleic acid molecules. The methods disclosed herein are drawn to binding a target sequence of interest within a target DNA molecule of interest and modifying the target DNA molecule of interest.

DETAILED DESCRIPTION

Many modifications and other embodiments of the inventions set forth herein will come to mind to one skilled in the art to which these inventions pertain having the benefit of the teachings presented in the foregoing descriptions. Therefore, it is to be understood that the inventions are not to be limited to the specific embodiments disclosed and that modifications and other embodiments are intended to be included within the scope of the appended claims.

Although specific terms are employed herein, they are used in a generic and descriptive sense only and not for purposes of limitation.

I. Overview

This disclosure provides novel adenine deaminases and fusion proteins that comprise a nucleic acid molecule-binding polypeptide, such as a DNA-binding polypeptide, and a novel deaminase polypeptide. In certain embodiments, the DNA-binding polypeptide is a sequence-specific DNA-binding polypeptide, in that the DNA-binding polypeptide binds to a target sequence at a greater frequency than binding to a randomized background sequence. In some embodiments, the DNA-binding polypeptide is or is derived from a meganuclease, zinc finger fusion protein, or TALEN. In some embodiments, the fusion protein comprises an RNA-guided DNA-binding polypeptide and a deaminase polypeptide. In some embodiments, the RNA-guided DNA-binding polypeptide is an RNA-guided nuclease, such as a Cas9 polypeptide domain that binds to a guide RNA (also referred to as gRNA), which, in turn, binds a target nucleic acid sequence via strand hybridization.

The deaminase polypeptides disclosed herein can deaminate a nucleobase, such as, for example, adenine. The deamination of a nucleobase by a deaminase can lead to a point mutation at the respective residue, which is referred to herein as "nucleic acid editing", or "base editing". Fusion proteins comprising an RNA-guided nuclease (RGN) polypeptide and a deaminase can thus be used for the targeted editing of nucleic acid sequences.

Such fusion proteins are useful for targeted editing of DNA in vitro, e.g., for the generation of genetically modified cells. These genetically modified cells may be plant cells or animal cells. Such fusion proteins may also be useful for the introduction of targeted mutations, e.g., for the correction of genetic defects in mammalian cells ex vivo, e.g., in cells obtained from a subject that are subsequently re-introduced into the same or another subject; and for the introduction of targeted mutations, e.g., the correction of genetic defects or the introduction of deactivating mutations in disease-associated genes in a mammalian subject. Such fusion proteins may also be useful for the introduction of targeted mutations in plant cells, e.g., for the introduction of beneficial or agronomically valuable traits or alleles.

The terms "protein," "peptide," and "polypeptide" are used interchangeably herein, and refer to a polymer of amino acid residues linked together by peptide (amide) bonds. The terms refer to a protein, peptide, or polypeptide of any size, structure, or function. Typically, a protein, peptide, or polypeptide will be at least three amino acids long. A protein, peptide, or polypeptide may refer to an individual protein or a collection of proteins. One or more of the amino acids in a protein, peptide, or polypeptide may be modified, for example, by the addition of a chemical entity such as a carbohydrate group, a hydroxyl group, a phosphate group, a farnesyl group, an isofarnesyl group, a fatty acid group, a linker for conjugation, functionalization, or other modification, etc. A protein, peptide, or polypeptide may also be a single molecule or may be a multi-molecular complex. A protein, peptide, or polypeptide may be just a fragment of a naturally occurring protein or peptide. A protein, peptide, or polypeptide may be naturally occurring, recombinant, or synthetic, or any combination thereof.

Any of the proteins provided herein may be produced by any method known in the art. For example, the proteins provided herein may be produced via recombinant protein expression and purification, which is especially suited for fusion proteins comprising a peptide linker. Methods for recombinant protein expression and purification are well known, and include those described by Green and Sambrook, *Molecular Cloning: A Laboratory Manual* (4th ed., Cold Spring Harbor Laboratory Press, Cold Spring Harbor, N.Y. (2012)), the entire contents of which are incorporated herein by reference.

II. Deaminases

The term "deaminase" refers to an enzyme that catalyzes a deamination reaction. The deaminases of the invention are nucleobase deaminases and the terms "deaminase" and "nucleobase deaminase" are used interchangeably herein. The deaminase may be a naturally-occurring deaminase enzyme or an active fragment or variant thereof. A deaminase may be active on single-stranded nucleic acids, such as ssDNA or ssRNA, or on double-stranded nucleic acids, such as dsDNA or dsRNA. In some embodiments, the deaminase is only capable of deaminating ssDNA and does not act on dsDNA.

The presently disclosed methods and compositions comprise an adenine deaminase. In some embodiments, the deaminase is an ADAT family deaminase or a variant thereof. Deamination of adenine, adenosine, or deoxyadenosine yields inosine, which is treated as guanine by polymerases. To date there are no known naturally occurring adenine deaminases that deaminate adenine in DNA. Several methods have been employed to evolve and optimize adenine deaminase acting on tRNA (ADAT) proteins to be active on DNA molecules in mammalian cells (Gaudelli et al, 2017; Koblan, L. W. et al, 2018, *Nat Biotechnol* 36, 843-846; Richter, M. F. et al, 2020, *Nat Biotechnol*, doi: 10.1038/s41587-020-0562-8, each of which are incorporated by reference in their entirety herein). One such method uses a bacterial selection assay where only cells with the ability to activate antibiotic resistance through A:T>G:C conversions are able to survive.

The present invention relates to novel adenine deaminase polypeptides which were produced through evolution and optimization of bacterial deaminases. Novel adenine deaminases are presently disclosed and set forth as SEQ ID NOs: 1-10 and 399-441. The deaminases of the invention may be used for editing of DNA or RNA molecules. In some embodiments, the deaminases of the invention may be used for editing of ssDNA or ssRNA molecules. The adenine deaminases described herein are useful as deaminases alone or as components in fusion proteins. A fusion protein comprising a DNA-targeting polypeptide and an adenine deaminase polypeptide is referred to herein as an "A-based editor", "adenine base editor", or an "ABE" and can be used for the targeted editing of nucleic acid sequences.

"Base editors" are fusion proteins comprising a DNA-targeting polypeptide, such as an RGN, and a deaminase. Adenine base editors (ABEs) comprise a DNA-targeting protein, such as an RGN, and an adenine deaminase. ABEs function through the deamination of adenine into inosine on a DNA target molecule (Gaudelli, N. M. et al. 2017). Inosine is recognized as a guanine by polymerases and allows for the incorporation of a cytosine on the complementary DNA strand across from the inosine. After a round of replication post-deamination, there is a resulting A:T to G:C base pair change in the genome. In some embodiments, the presently disclosed adenine deaminases or active variants or fragments thereof introduce A>N mutations in a DNA molecule, wherein N is C, G, or T. In further embodiments, they introduce A>G mutations in a DNA molecule.

In those embodiments wherein the deaminase has been targeted to a specific region of a nucleic acid molecule via fusion with a DNA-binding polypeptide, the mutation rate of adenines within or adjacent to the target sequence to which the DNA-binding polypeptide binds can be measured using any method known in the art, including polymerase chain reaction (PCR), restriction fragment length polymorphism (RFLP), or DNA sequencing.

The presently disclosed novel deaminases or active variants or fragments thereof that retain deaminase activity may be introduced into the cell as part of a deaminase-DNA-binding polypeptide fusion, and/or may be co-expressed with a DNA-binding polypeptide-deaminase fusion, to increase the efficiency of introducing the desired A>G mutation in a target DNA molecule. The presently disclosed deaminases have the amino acid sequence of any of SEQ ID NOs: 1-10 and 399-441 or a variant or fragment thereof retaining deaminase activity. In some embodiments, the deaminase has an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% identity to the amino acid sequence of any of SEQ ID NOs: 1-10 and 399-441. In particular embodiments, the deaminase comprises an amino acid sequence having at least 80% sequence identity to any one of SEQ ID NOs: 407, 405, 399, 1-10, 400-404, 406, and 408-441. In some embodiments, the deaminase comprises an amino acid sequence having at least 80% sequence identity to SEQ ID NO: 407. For example, the deaminase comprises an amino acid sequence having at least about 80% identity, at least about 90% identity, at least about 95% identity, at least about 96% identity, at least about 97% identity, at least about 98% identity, at least about 99% identity, at least about 99.5% identity, or at least about 99.9% identity to SEQ ID NO: 407. In some embodiments, the deaminase comprises an amino acid sequence having at least 80% identity, at least 90% identity, at least 95% identity, at least 96% identity, at least 97% identity, at least 98% identity, at least 99% identity, at least 99.5% identity, or at least 99.9% identity to SEQ ID NO: 407. In some embodiments, the deaminase comprises the amino acid sequence of SEQ ID NO: 407. In some embodiments, the deaminase comprises an amino acid sequence having at least 80% sequence identity to SEQ ID NO: 399. For example, the deaminase comprises an amino acid sequence having at least about 80% identity, at least about 90% identity, at least about 95% identity, at least about 96% identity, at least about 97% identity, at least about 98% identity, at least about 99% identity, at least about 99.5% identity, or at least about 99.9% identity to SEQ ID NO: 399. In some embodiments, the deaminase comprises an amino acid sequence having at least 80% identity, at least 90% identity, at least 95% identity, at least 96% identity, at least 97% identity, at least 98% identity, at least 99% identity, at least 99.5% identity, or at least 99.9% identity to SEQ ID NO: 399. In some embodiments, the deaminase comprises the amino acid sequence of SEQ ID NO: 399. In some embodiments, the deaminase comprises an amino acid sequence having at least 80% sequence identity to SEQ ID NO: 405. For example, the deaminase comprises an amino acid sequence having at least about 80% identity, at least about 90% identity, at least about 95% identity, at least about 96% identity, at least about 97% identity, at least about 98% identity, at least about 99% identity, at least about 99.5% identity, or at least about 99.9% identity to SEQ ID NO: 405. In some embodiments, the deaminase comprises an amino acid sequence having at least 80% identity, at least 90% identity, at least 95% identity, at least 96% identity, at least 97% identity, at least 98% identity, at least 99% identity, at least 99.5% identity, or at least 99.9% identity to SEQ ID NO: 405. In some embodiments, the deaminase comprises the amino acid sequence of SEQ ID NO: 405.

III. Nucleic Acid Molecule-Binding Polypeptides

Some aspects of this disclosure provide fusion proteins that comprise a nucleic acid molecule-binding polypeptide and a deaminase polypeptide. While binding to and targeted editing of RNA molecules is contemplated by the present invention, in some embodiments, the nucleic acid molecule-binding polypeptide of the fusion protein is a DNA-binding polypeptide. Such fusion proteins are useful for targeted editing of DNA in vitro, ex vivo, or in vivo. These novel fusion proteins are active in mammalian cells and are useful for targeted editing of DNA molecules.

The term "fusion protein" as used herein refers to a hybrid polypeptide which comprises protein domains from at least two different proteins. A fusion protein may comprise more than one different domain, for example, a DNA-binding domain and a deaminase. In some embodiments, a fusion protein is in a complex with, or is in association with, a nucleic acid, e.g., RNA.

In some embodiments, the presently disclosed fusion proteins comprise a DNA-binding polypeptide. As used herein, the term "DNA-binding polypeptide" refers to any polypeptide which is capable of binding to DNA. In certain embodiments, the DNA-binding polypeptide portion of the presently disclosed fusion proteins binds to double-stranded DNA. In particular embodiments, the DNA-binding polypeptide binds to DNA in a sequence-specific manner. As used herein, the terms "sequence-specific" or "sequence-specific manner" refer to the selective interaction with a specific nucleotide sequence.

Two polynucleotide sequences can be considered to be substantially complementary when the two sequences hybridize to each other under stringent conditions. Likewise, a DNA-binding polypeptide is considered to bind to a particular target sequence in a sequence-specific manner if the DNA-binding polypeptide binds to its sequence under stringent conditions. By "stringent conditions" or "stringent hybridization conditions" is intended conditions under which the two polynucleotide sequences (or the polypeptide binds to its specific target sequence) will bind to each other to a detectably greater degree than to other sequences (e.g., at least 2-fold over background). Stringent conditions are sequence-dependent and will be different in different circumstances. Typically, stringent conditions will be those in which the salt concentration is less than 1.5 M Na ion, typically about 0.01 to 1.0 M Na ion concentration (or other salts) at pH 7.0 to 8.3, and the temperature is at least 30° C. for short sequences (e.g., 10 to 50 nucleotides) and at least 60° C. for long sequences (e.g., greater than 50 nucleotides). Stringent conditions may also be achieved with the addition of destabilizing agents such as formamide. Exemplary low stringency conditions include hybridization with a buffer solution of 30 to 35% formamide, 1 M NaCl, 1% SDS (sodium dodecyl sulfate) at 37° C., and a wash in 1× to 2×SSC (20×SSC=3.0 M NaCl/0.3 M trisodium citrate) at 50 to 55° C. Exemplary moderate stringency conditions include hybridization in 40 to 45% formamide, 1.0 M NaCl, 1% SDS at 37° C., and a wash in 0.5× to 1×SSC at 55 to 60° C. Exemplary high stringency conditions include hybridization in 50% formamide, 1 M NaCl, 1% SDS at 37° C., and a wash in 0.1×SSC at 60 to 65° C. Optionally, wash buffers may comprise about 0.1% to about 1% SDS. Duration of hybridization is generally less than about 24 hours, usually about 4 to about 12 hours. The duration of the wash time will be at least a length of time sufficient to reach equilibrium.

The Tm is the temperature (under defined ionic strength and pH) at which 50% of a complementary target sequence hybridizes to a perfectly matched sequence. For DNA-DNA hybrids, the Tm can be approximated from the equation of Meinkoth and Wahl (1984) Anal. Biochem. 138:267-284: Tm=81.5° C.+16.6 (log M)+0.41 (% GC)−0.61 (% form)−500/L; where M is the molarity of monovalent cations, % GC is the percentage of guanosine and cytosine nucleotides in the DNA, % form is the percentage of formamide in the hybridization solution, and L is the length of the hybrid in base pairs. Generally, stringent conditions are selected to be about 5° C. lower than the thermal melting point (Tm) for the specific sequence and its complement at a defined ionic strength and pH. However, severely stringent conditions can utilize a hybridization and/or wash at 1, 2, 3, or 4° C. lower than the thermal melting point (Tm); moderately stringent conditions can utilize a hybridization and/or wash at 6, 7, 8, 9, or 10° C. lower than the thermal melting point (Tm); low stringency conditions can utilize a hybridization and/or wash at 11, 12, 13, 14, 15, or 20° C. lower than the thermal melting point (Tm). Using the equation, hybridization and wash compositions, and desired Tm, those of ordinary skill will understand that variations in the stringency of hybridization and/or wash solutions are inherently described. An extensive guide to the hybridization of nucleic acids is found in Tijssen (1993) Laboratory Techniques in Biochemistry and Molecular Biology—Hybridization with Nucleic Acid Probes, Part I, Chapter 2 (Elsevier, New York); and Ausubel et al., eds. (1995) Current Protocols in Molecular Biology, Chapter 2 (Greene Publishing and Wiley-Interscience, New York). See Sambrook et al. (1989) Molecular Cloning: A Laboratory Manual (2d ed., Cold Spring Harbor Laboratory Press, Plainview, New York).

In certain embodiments, the sequence-specific DNA-binding polypeptide is an RNA-guided, DNA-binding polypeptide (RGDBP). As used herein, the terms "RNA-guided, DNA-binding polypeptide" and "RGDBP" refer to polypeptides capable of binding to DNA through the hybridization of an associated RNA molecule with the target DNA sequence.

In some embodiments, the DNA-binding polypeptide of the fusion protein is a nuclease, such as a sequence-specific nuclease. As used herein, the term "nuclease" refers to an enzyme that catalyzes the cleavage of phosphodiester bonds between nucleotides in a nucleic acid molecule. In some embodiments, the DNA-binding polypeptide is an endonuclease, which is capable of cleaving phosphodiester bonds between nucleotides within a nucleic acid molecule, whereas in certain embodiments, the DNA-binding polypeptide is an exonuclease that is capable of cleaving the nucleotides at either end (5' or 3') of a nucleic acid molecule. In some embodiments, the sequence-specific nuclease is selected from the group consisting of a meganuclease, a zinc finger nuclease, a TAL-effector DNA binding domain-nuclease fusion protein (TALEN), and an RNA-guided nuclease (RGN) or variants thereof wherein the nuclease activity has been reduced or inhibited.

As used herein, the term "meganuclease" or "homing endonuclease" refers to endonucleases that bind a recognition site within double-stranded DNA that is 12 to 40 bp in length. Non-limiting examples of meganucleases are those that belong to the LAGLIDADG family that comprise the conserved amino acid motif LAGLIDADG (SEQ ID NO: 49). The term "meganuclease" can refer to a dimeric or single-chain meganuclease.

As used herein, the term "zinc finger nuclease" or "ZFN" refers to a chimeric protein comprising a zinc finger DNA-binding domain and a nuclease domain.

As used herein, the term "TAL-effector DNA binding domain-nuclease fusion protein" or "TALEN" refers to a chimeric protein comprising a TAL effector DNA-binding domain and a nuclease domain.

As used herein, the term "RNA-guided nuclease" or "RGN" refers to an RNA-guided, DNA-binding polypeptide that has nuclease activity. RGNs are considered "RNA-guided" because guide RNAs form a complex with the RNA-guided nucleases to direct the RNA-guided nuclease to bind to a target sequence and in some embodiments, introduce a single-stranded or double-stranded break at the target sequence. The RGN may be a CasX, a CasY, a C2c1, a C2c2, a C2c3, a GeoCas9, aSpCas9, a SaCas9, a Nme2Cas9, a CjCas9, a Cas12a (formerly known as Cpf1), a Cas12b, a Cas12g, a Cas12h, a Cas12i, aLbCas12a, a AsCas12a, a CasMINI, a Cas13b, a Cas13c, a Cas13d, a Cas14, a Csn2, an xCas9, an SpCas9-NG, an LbCas12a, an AsCas12a, a Cas9-KKH, a circularly permuted Cas9, an Argonaute (Ago), a SmacCas9, or a Spy-macCas9, a Spy-macCas9 domain, or a RGN with an amino acid sequence set forth in any one of SEQ ID NOs: 41, 60, 366, or 368. In some embodiments, as described below, the RGNs provided herein are RGN nickases.

According to the present invention, an RGN protein that has been mutated to become nuclease-inactive or "dead", such as for example dCas9, can be referred to as an RNA-guided, DNA-binding polypeptide or a nuclease-inactive RGN or nuclease-dead RGN. Additionally, suitable nuclease-inactive Cas9 domains of other known RNA guided nucleases (RGNs) can be determined (for example, a nuclease-inactive variant of the RGN APG08290.1 disclosed in U.S. Patent Publication No. 2019/0367949, the entire contents of which are incorporated herein by reference herein).

In some embodiments, the fusion protein comprises an RGN fused to a deaminase described herein. In those embodiments of fusion proteins described above, the deaminase is selected from deaminases comprising an amino acid sequence having at least 80% sequence identity to any one of SEQ ID NOs: 1-10 and 399-441. In some embodiments, the deaminase comprises an amino acid sequence having at least 80% sequence identity to SEQ ID NO: 407. In some embodiments, the deaminase comprises an amino acid sequence having at least 80% sequence identity to SEQ ID NO: 399. In some embodiments, the deaminase comprises an amino acid sequence having at least 80% sequence identity to SEQ ID NO: 405. In those embodiments of fusion proteins described above, the RGN is selected from a CasX, a CasY, a C2c1, a C2c2, a C2c3, a GeoCas9, aSpCas9, a SaCas9, a Nme2Cas9, a CjCas9, a Cas12a (formerly known as Cpf1), a Cas12b, a Cas12g, a Cas12h, a Cas12i, aLbCas12a, a AsCas12a, a CasMINI, a Cas13b, a Cas13c, a Cas13d, a Cas14, a Csn2, an xCas9, an SpCas9-NG, an LbCas12a, an AsCas12a, a Cas9-KKH, a circularly permuted Cas9, an Argonaute (Ago), a SmacCas9, a Spy-macCas9 domain, or an RGN with an amino acid sequence set forth in any one of SEQ ID NOs: 41, 60, 366, or 368. In particular embodiments, the fusion protein comprises a Cas9 nickase fused to a deaminase comprising an amino acid sequence having at least 80% sequence identity to SEQ ID NO: 407. In some embodiments, the fusion protein comprises a Cas9 nickase fused to a deaminase comprising an amino acid sequence having at least 80% sequence identity to SEQ ID NO: 399. In particular embodiments, the fusion protein comprises a Cas9 nickase fused to a deaminase comprising an amino acid sequence having at least 80% sequence identity to SEQ ID NO: 405. The Cas9 nickase, can be any Cas9 nickase disclosed in PCT Patent Publication No. WO2020181195, the entire contents of which is incorporated herein by reference herein.

The term "RGN polypeptide" encompasses RGN polypeptides that only cleave a single strand of a target nucleotide sequence, which is referred to herein as a nickase. Such RGNs have a single functioning nuclease domain. RGN nickases can be naturally-occurring nickases or can be RGN proteins that naturally cleave both strands of a double-stranded nucleic acid molecule that have been mutated within one or more nuclease domains such that the nuclease activity of these mutated domains is reduced or eliminated, to become a nickase. In some embodiments, the nickase RGN of the fusion protein comprises a mutation (e.g., a D10A mutation) which renders the RGN capable of cleaving only the non-base edited, target strand (the strand which comprises the PAM and is base paired to a gRNA) of a nucleic acid duplex. This D10A mutation mutates the first aspartic acid residue in the split RuvC nuclease domain of the RGN. The present application discloses several D10A nickase variants or homologous nickase variants of described RGNs (see Example 4). nAPG07433.1 and nAPG08290.1 (set forth as SEQ ID NOs: 42 and 61, respectively) are nickase variants of APG07433.1 and APG08290.1, which are set forth as SEQ ID NO: 41 and 60, respectively, and are described in WO 2019/236566 (incorporated by reference in its entirety herein). nAPG00969 (set for as SEQ ID NO: 52) and nAPG09748 (set forth as SEQ ID NO: 54) are nickase variants of APG00969 and APG09748, respectively, which are described in WO 2020/139783 (incorporated by reference in its entirety herein). nAPG06646 (set forth as SEQ ID NO: 53) and nAPG09882 (set forth as SEQ ID NO: 55) are nickase variants of APG06646 and APG09882, respectively, which are described in PCT publication WO 2021/030344 (incorporated by reference in its entirety herein). nAPG03850, nAPG07553, nAPG055886, and nAPG01604 are set forth as SEQ ID NOs: 56-59, respectively, and are nickase variants of APG03850, APG07553, APG055886, and APG01604 which are described in the pending PCT Application No. PCT/US2021/028843 (incorporated by reference in its entirety herein). Various RGN nickases, their variants and their sequences are disclosed in PCT Patent Publication No. WO2020181195, the entire contents of which are incorporated herein by reference herein. One exemplary suitable nuclease-inactive Cas9 is the D10A/H840A Cas9 mutant (see, e.g., Qi et al., *Cell*. 2013; 152(5): 1173-83, the entire contents of which are incorporated herein by reference).

In some embodiments, the nickase RGN of the fusion protein comprises a mutation (e.g., a H840A mutation), which renders the RGN capable of cleaving only the base-edited, non-targeted strand (the strand which does not comprise the PAM and is not base paired to a gRNA) of a nucleic acid duplex. The H840A mutation mutates the first histidine of the HNH nuclease domain. A nickase RGN comprising an H840A mutation, or an equivalent mutation, has an inactivated HNH domain. A nickase RGN with an H840A mutation cleaves the non-targeted strand. A nickase comprising a D10A mutation, or an equivalent mutation, has an inactivated RuvC nuclease domain and cleaves the targeted strand. D10A nickases are not able to cleave the non-targeted strand of the DNA, i.e., the strand where base editing is desired.

Other additional exemplary suitable nuclease inactive Cas9 domains include, but are not limited to, D10A/D839A/H840A, and D10A/D839A/H840A/N863A mutant domains (See, e.g., Mali et al., *Nature Biotechnology*. 2013; 31(9): 833-838, the entire contents of which are incorporated herein by reference). Additional suitable RGN proteins mutated to be nickases will be apparent to those of skill in the art based on this disclosure and knowledge in the field (such as for example the RGNs disclosed in PCT Publication Nos. WO 2019/236566, WO2020181195, which are herein incorporated by reference in their entirety) and are within the scope of this disclosure. In preferred embodiments, an RGN which has nickase activity on the target strand nicks the target strand, while the complementary, non-target strand is modified by the deaminase. Cellular DNA-repair machinery may repair the nicked, target strand using the modified non-target strand as a template, thereby introducing a mutation in the DNA.

In some embodiments the RGN nickase retaining nickase activity comprises an amino acid sequence that has at least 60%, at least 65%, at least 70%, at least 75%, at least 80%, at least 85%, at least 90%, at least 95%, at least 96%, at least 97%, at least 98%, at least 99%, or at least 99.5% identity to SEQ ID NO: 42 or any one of SEQ ID NOs: 52-59, 61, 397, and 398.

Any method known in the art for introducing mutations into an amino acid sequence, such as PCR-mediated mutagenesis and site-directed mutagenesis, can be used for generating nickases or nuclease-dead RGNs. See, e.g., U.S. Publ. No. 2014/0068797 and U.S. Pat. No. 9,790,490; each of which is incorporated herein by reference in its entirety. RNA-guided nucleases (RGNs) allow for the targeted manipulation of a single site within a genome and are useful in the context of gene targeting for therapeutic and research applications. In a variety of organisms, including mammals, RNA-guided nucleases have been used for genome engineering by stimulating either non-homologous end joining or homologous recombination. RGNs include CRISPR-Cas proteins, which are RNA-guided nucleases directed to the target sequence by a guide RNA (gRNA) as part of a Clustered Regularly Interspaced Short Palindromic Repeats (CRISPR) RNA-guided nuclease system, or active variants or fragments thereof.

Further provided herein are RGN polypeptides (and nucleic acid molecules encoding RGN polypeptides) that comprise the amino acid sequence set forth as SEQ ID NO: 41 or 60, but lacking amino acid residues 590 to 597 of SEQ ID NO: 41 or 60, or an active variant or fragment thereof. In certain embodiments, the RGN polypeptide comprises the amino acid sequence set forth as SEQ ID NO: 366, 368, 397, or 398 or an active variant or fragment thereof.

Some aspects of this disclosure provide fusion proteins that comprise an RNA-guided DNA-binding polypeptide and a deaminase polypeptide, specifically an adenine deaminase polypeptide. In some embodiments, the RNA-guided DNA-binding polypeptide is an RNA-guided nuclease. In further embodiments, the RNA-guided nuclease is a naturally-occurring CRISPR-Cas protein or an active variant or fragment thereof. CRISPR-Cas systems are classified into Class 1 or Class 2 systems. Class 2 systems comprise a single effector nuclease and include Types II, V, and VI. The Class 1 and 2 systems are subdivided into types (Types I, II, III, IV, V, VI), with some types further divided into subtypes (e.g., Type II-A, Type II-B, Type II-C, Type V-A, Type V-B).

In certain embodiments, the CRISPR-Cas protein is a naturally-occurring Type II CRISPR-Cas protein or an active variant or fragment thereof. As used herein, the term "Type II CRISPR-Cas protein," "Type II CRISPR-Cas effector protein," or "Cas9" refers to a CRISPR-Cas effector protein that requires a trans-activating RNA (tracrRNA) and comprises two nuclease domains (i.e., RuvC and HNH), each of which is responsible for cleaving a single strand of a double-stranded DNA molecule. In some embodiments, the present invention provides a fusion protein comprising a presently disclosed deaminase fused to *Streptococcus pyogenes* Cas9 (SpCas9) or a SpCas9 nickase, the sequences of which are set forth as SEQ ID NOs: 555 and 556, respectively, and are described in U.S. Pat. Nos. 10,000,772 and 8,697,359, each of which is herein incorporated by reference in its entirety. In some embodiments, the present invention provides a fusion protein comprising a presently disclosed deaminase fused to *Streptococcus thermophilus* Cas9 (StCas9) or a StCas9 nickase, the sequences of which are set forth as SEQ ID NOs: 557 and 558, respectively, and are disclosed in U.S. Pat. No. 10,113,167, which is herein incorporated by reference in its entirety. In some embodiments, the present invention provides a fusion protein comprising a presently disclosed deaminase fused to *Streptococcus aureus* Cas9 (SaCas9) or a SaCas9 nickase, the sequences of which are set forth as SEQ ID NOs: 559 and 560, respectively, and are disclosed in U.S. Pat. No. 9,752,132, which is herein incorporated by reference in its entirety.

In some embodiments, the CRISPR-Cas protein is a naturally-occurring Type V CRISPR-Cas protein or an active variant or fragment thereof. As used herein, the term "Type V CRISPR-Cas protein," "Type V CRISPR-Cas effector protein," or "Cas12" refers to a CRISPR-Cas effector protein that cleaves dsDNA and comprises a single RuvC nuclease domain or a split-RuvC nuclease domain and lacks an HNH domain (Zetsche et al 2015, *Cell* doi:10.1016/j.cell.2015.09.038; Shmakov et al 2017, Nat Rev Microbiol doi:10.1038/nrmicro.2016.184; Yan et al 2018, Science doi: 10.1126/science.aav7271; Harrington et al 2018, Science doi:10.1126/science.aav4294). It is to be noted that Cas12a is also referred to as Cpf1, and does not require a tracrRNA, although other Type V CRISPR-Cas proteins, such as Cas12b, do require a tracrRNA. Most Type V effectors can also target ssDNA (single-stranded DNA), often without a PAM requirement (Zetsche et al 2015; Yan et al 2018; Harrington et al 2018). The term "Type V CRISPR-Cas protein" encompasses the unique RGNs comprising split RuvC nuclease domains, such as those disclosed in U.S. Provisional Appl. Nos. 62/955,014 filed Dec. 30, 2019 and 63/058,169 filed Jul. 29, 2020, and PCT International Appl. No. PCT/US2020/067138 filed Dec. 28, 2020, the contents of each of which are incorporated herein by reference in its entirety. In some embodiments, the present invention provides a fusion protein comprising a presently disclosed deaminase fused to Francisella novicida Cas12a (FnCas12a), the sequence of which is set forth as SEQ ID NOs: 561 and is disclosed in U.S. Pat. No. 9,790,490, which is herein incorporated by reference in its entirety, or any of the nuclease-inactivating mutants of FnCas12a disclosed within U.S. Pat. No. 9,790,490.

In some embodiments, the CRISPR-Cas protein is a naturally-occurring Type VI CRISPR-Cas protein or an active variant or fragment thereof. As used herein, the term "Type VI CRISPR-Cas protein," "Type VI CRISPR-Cas effector protein," or "Cas13" refers to a CRISPR-Cas effector protein that does not require a tracrRNA and comprises two HEPN domains that cleave RNA.

The term "guide RNA" refers to a nucleotide sequence having sufficient complementarity with a target nucleotide sequence to hybridize with the target sequence and direct sequence-specific binding of an associated RGN to the target nucleotide sequence. For CRISPR-Cas RGNs, the respective guide RNA is one or more RNA molecules (generally, one or two), that can bind to the RGN and guide the RGN to bind to a particular target nucleotide sequence, and in those instances wherein the RGN has nickase or nuclease activity, also cleave the target nucleotide sequence. A guide RNA comprises a CRISPR RNA (crRNA) and in some embodiments, a trans-activating CRISPR RNA (tracrRNA).

A CRISPR RNA comprises a spacer sequence and a CRISPR repeat sequence. The "spacer sequence" is the nucleotide sequence that directly hybridizes with the target nucleotide sequence of interest. The spacer sequence is engineered to be fully or partially complementary with the target sequence of interest. In various embodiments, the spacer sequence comprises from about 8 nucleotides to about 30 nucleotides, or more. For example, the spacer sequence can be about 8, about 9, about 10, about 11, about 12, about 13, about 14, about 15, about 16, about 17, about 18, about 19, about 20, about 21, about 22, about 23, about 24, about 25, about 26, about 27, about 28, about 29, about 30, or more nucleotides in length. In some embodiments, the spacer sequence is 8, 9, 10, 11, 12, 13, 14, 15, 16, 17, 18, 19, 20, 21, 22, 23, 24, 25, 26, 27, 28, 29, 30, or more nucleotides in length. In some embodiments, the spacer sequence is about 10 to about 26 nucleotides in length, or about 12 to about 30 nucleotides in length. In some embodiments, the spacer sequence is 10 to 26 nucleotides in length, or 12 to 30 nucleotides in length. In particular embodiments, the spacer sequence is about 30 nucleotides in length. In particular embodiments, the spacer sequence is 30 nucleotides in length. In some embodiments, the degree of complementarity between a spacer sequence and its corresponding target sequence, when optimally aligned using a suitable alignment algorithm, is between 50% and 99% or more, including but not limited to about or more than about 50%, about 60%, about 70%, about 75%, about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, about 99%, or more. In particular embodiments, the degree of complementarity between a spacer sequence and its corresponding target sequence, when optimally aligned using a suitable alignment algorithm, is 50%, 60%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more. In particular embodiments, the spacer sequence is free of secondary structure, which can be predicted using any suitable polynucleotide folding algorithm known in the art, including but not limited to mFold (see, e.g., Zuker and Stiegler (1981) *Nucleic Acids Res.* 9:133-148) and RNAfold (see, e.g., Gruber et al. (2008) *Cell* 106(1):23-24).

The CRISPR RNA repeat sequence comprises a nucleotide sequence that forms a structure, either on its own or in concert with a hybridized tracrRNA, that is recognized by the RGN molecule. In various embodiments, the CRISPR RNA repeat sequence comprises from about 8 nucleotides to about 30 nucleotides, or more. In particular embodiments, the CRISPR RNA repeat sequence comprises from 8 nucleotides to 30 nucleotides, or more. For example, the CRISPR repeat sequence can be about 8, about 9, about 10, about 11, about 12, about 13, about 14, about 15, about 16, about 17, about 18, about 19, about 20, about 21, about 22, about 23, about 24, about 25, about 26, about 27, about 28, about 29, about 30, or more nucleotides in length. In particular embodiments, the CRISPR repeat sequence is 8, 9, 10, 11, 12, 13, 14, 15, 16, 17, 18, 19, 20, 21, 22, 23, 24, 25, 26, 27, 28, 29, 30, or more nucleotides in length. In some embodiments, the degree of complementarity between a CRISPR repeat sequence and its corresponding tracrRNA sequence, when optimally aligned using a suitable alignment algorithm, is between 50% and 99%, or more, including but not limited to about or more than about 50%, about 60%, about 70%, about 75%, about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, about 99%, or more. In particular embodiments, the degree of complementarity between a CRISPR repeat sequence and its corresponding tracrRNA sequence, when optimally aligned using a suitable alignment algorithm, is 50%, 60%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more.

In some embodiments, the guide RNA further comprises a tracrRNA molecule. A trans-activating CRISPR RNA or tracrRNA molecule comprises a nucleotide sequence comprising a region that has sufficient complementarity to hybridize to a CRISPR repeat sequence of a crRNA, which is referred to herein as the anti-repeat region. In some embodiments, the tracrRNA molecule further comprises a region with secondary structure (e.g., stem-loop) or forms secondary structure upon hybridizing with its corresponding crRNA. In particular embodiments, the region of the tracrRNA that is fully or partially complementary to a CRISPR repeat sequence is at the 5' end of the molecule and the 3' end of the tracrRNA comprises secondary structure. This region of secondary structure generally comprises several hairpin structures, including the nexus hairpin, which is found adjacent to the anti-repeat sequence. There are often terminal hairpins at the 3' end of the tracrRNA that can vary in structure and number, but often comprise a GC-rich Rho-independent transcriptional terminator hairpin followed by a string of Us at the 3' end. See, for example, Briner et al. (2014) *Molecular Cell* 56:333-339, Briner and Barrangou (2016) *Cold Spring Harb Protoc*; doi: 10.1101/pdb.top090902, and U.S. Publication No. 2017/0275648, each of which is herein incorporated by reference in its entirety.

In various embodiments, the anti-repeat region of the tracrRNA that is fully or partially complementary to the CRISPR repeat sequence comprises from about 6 nucleotides to about 30 nucleotides, or more. For example, the region of base pairing between the tracrRNA anti-repeat sequence and the CRISPR repeat sequence can be about 6, about 7, about 8, about 9, about 10, about 11, about 12, about 13, about 14, about 15, about 16, about 17, about 18, about 19, about 20, about 21, about 22, about 23, about 24, about 25, about 26, about 27, about 28, about 29, about 30, or more nucleotides in length. In particular embodiments, the region of base pairing between the tracrRNA anti-repeat sequence and the CRISPR repeat sequence is 6, 7, 8, 9, 10, 11, 12, 13, 14, 15, 16, 17, 18, 19, 20, 21, 22, 23, 24, 25, 26, 27, 28, 29, 30, or more nucleotides in length. In particular embodiments, the anti-repeat region of the tracrRNA that is fully or partially complementary to a CRISPR repeat sequence is about 10 nucleotides in length. In particular embodiments, the anti-repeat region of the tracrRNA that is fully or partially complementary to a CRISPR repeat sequence is 10 nucleotides in length. In some embodiments, the degree of complementarity between a CRISPR repeat sequence and its corresponding tracrRNA anti-repeat sequence, when optimally aligned using a suitable alignment algorithm, is between 50% and 99% or more, including but not limited to about or more than about 50%, about 60%, about 70%, about 75%, about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, about 99%, or more. In particular embodiments, the degree of complementarity between a CRISPR repeat sequence and its corresponding tracrRNA anti-repeat sequence, when optimally aligned using a suitable alignment algorithm, is 50%, 60%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more.

In various embodiments, the entire tracrRNA comprises from about 60 nucleotides to more than about 210 nucleotides. In particular embodiments, the entire tracrRNA comprises from 60 nucleotides to more than 210 nucleotides. For example, the tracrRNA can be about 60, about 65, about 70, about 75, about 80, about 85, about 90, about 95, about 100, about 105, about 110, about 115, about 120, about 125, about 130, about 135, about 140, about 150, about 160, about 170, about 180, about 190, about 200, about 210 or more nucleotides in length. In particular embodiments, the tracrRNA is 60, 65, 70, 75, 80, 85, 90, 95, 100, 105, 110, 115, 120, 125, 130, 135, 140, 150, 160, 170, 180, 190, 200, 210 or more nucleotides in length. In particular embodiments, the tracrRNA is about 100 to about 210 nucleotides in length, including about 95, about 96, about 97, about 98, about 99, about 100, about 105, about 106, about 107, about 108, about 109, and about 100 nucleotides in length. In particular embodiments, the tracrRNA is 100 to 110 nucleotides in length, including 95, 96, 97, 98, 99, 100, 105, 106, 107, 108, 109, and 110 nucleotides in length.

Guide RNAs form a complex with an RNA-guided, DNA-binding polypeptide or an RNA-guided nuclease to direct the RNA-guided nuclease to bind to a target sequence. If the guide RNA complexes with an RGN, the bound RGN introduces a single-stranded or double-stranded break at the target sequence. After the target sequence has been cleaved, the break can be repaired such that the DNA sequence of the target sequence is modified during the repair process. Provided herein are methods for using mutant variants of RNA-guided nucleases, which are either nuclease inactive or nickases, which are linked to deaminases to modify a target sequence in the DNA of host cells. The mutant variants of RNA-guided nucleases in which the nuclease activity is inactivated or significantly reduced may be referred to as RNA-guided, DNA-binding polypeptides, as the polypeptides are capable of binding to, but not necessarily cleaving, a target sequence. RNA-guided nucleases only capable of cleaving a single strand of a double-stranded nucleic acid molecule are referred to herein as nickases.

A target nucleotide sequence is bound by an RNA-guided, DNA-binding polypeptide and hybridizes with the guide RNA associated with the RGDBP. The target sequence can then be subsequently cleaved if the RGDBP possesses nuclease activity (i.e., is an RGN), which encompasses activity as a nickase.

The guide RNA can be a single guide RNA or a dual-guide RNA system. A single guide RNA comprises the crRNA and optionally tracrRNA on a single molecule of RNA, whereas a dual-guide RNA system comprises a crRNA and a tracrRNA present on two distinct RNA molecules, hybridized to one another through at least a portion of the CRISPR repeat sequence of the crRNA and at least a portion of the tracrRNA, which may be fully or partially complementary to the CRISPR repeat sequence of the crRNA. In some of those embodiments wherein the guide RNA is a single guide RNA, the crRNA and optionally tracrRNA are separated by a linker nucleotide sequence.

In general, the linker nucleotide sequence is one that does not include complementary bases in order to avoid the formation of secondary structure within or comprising nucleotides of the linker nucleotide sequence. In some embodiments, the linker nucleotide sequence between the crRNA and tracrRNA is at least 3, at least 4, at least 5, at least 6, at least 7, at least 8, at least 9, at least 10, at least 11, at least 12, or more nucleotides in length. In particular embodiments, the linker nucleotide sequence between the crRNA and tracrRNA is 3, 4, 5, 6, 7, 8, 9, 10, 11, 12, or more nucleotides in length. In particular embodiments, the linker nucleotide sequence of a single guide RNA is at least 4 nucleotides in length. In particular embodiments, the linker nucleotide sequence of a single guide RNA is 4 nucleotides in length.

In certain embodiments, the guide RNA can be introduced into a target cell, organelle, or embryo as an RNA molecule. The guide RNA can be transcribed in vitro or chemically synthesized. In some embodiments, a nucleotide sequence encoding the guide RNA is introduced into the cell, organelle, or embryo. In some embodiments, the nucleotide sequence encoding the guide RNA is operably linked to a promoter (e.g., an RNA polymerase III promoter). The promoter can be a native promoter or heterologous to the guide RNA-encoding nucleotide sequence.

In various embodiments, the guide RNA can be introduced into a target cell, organelle, or embryo as a ribonucleoprotein complex, as described herein, wherein the guide RNA is bound to an RNA-guided nuclease polypeptide.

The guide RNA directs an associated RNA-guided nuclease to a particular target nucleotide sequence of interest through hybridization of the guide RNA to the target nucleotide sequence. A target nucleotide sequence can comprise DNA, RNA, or a combination of both and can be single-stranded or double-stranded. A target nucleotide sequence can be genomic DNA (i.e., chromosomal DNA), plasmid DNA, or an RNA molecule (e.g., messenger RNA, ribosomal RNA, transfer RNA, micro RNA, small interfering RNA). The target nucleotide sequence can be bound (and in some embodiments, cleaved) by an RNA-guided, DNA-binding polypeptide in vitro or in a cell. The chromosomal sequence targeted by the RGDBP can be a nuclear, plastid or mitochondrial chromosomal sequence. In some embodiments, the target nucleotide sequence is unique in the target genome.

In some embodiments, the target nucleotide sequence is adjacent to a protospacer adjacent motif (PAM). A PAM is generally within about 1 to about 10 nucleotides from the target nucleotide sequence, including about 1, about 2, about 3, about 4, about 5, about 6, about 7, about 8, about 9, or about 10 nucleotides from the target nucleotide sequence. In particular embodiments, a PAM is within 1 to 10 nucleotides from the target nucleotide sequence, including 1, 2, 3, 4, 5, 6, 7, 8, 9, or 10 nucleotides from the target nucleotide sequence. The PAM can be 5' or 3' of the target sequence. In some embodiments, the PAM is 3' of the target sequence. Generally, the PAM is a consensus sequence of about 2-6 nucleotides, but in particular embodiments, is 1, 2, 3, 4, 5, 6, 7, 8, 9, or more nucleotides in length.

The PAM restricts which sequences a given RGDBP or RGN can target, as its PAM needs to be proximal to the target nucleotide sequence. Upon recognizing its corresponding PAM sequence, the RGN can cleave the target nucleotide sequence at a specific cleavage site. As used herein, a cleavage site is made up of the two particular nucleotides within a target nucleotide sequence between which the nucleotide sequence is cleaved by an RGN. The cleavage site can comprise the $1^{st}$ and $2^{nd}$, $2^{nd}$ and $3^{rd}$, $3^{rd}$ and $4^{th}$, $4^{th}$ and $5^{th}$, $5^{th}$ and $6^{th}$, $7^{th}$ and $8^{th}$, or $8^{th}$ and $9^{th}$ nucleotides from the PAM in either the 5' or 3' direction. As RGNs can cleave a target nucleotide sequence resulting in staggered ends, in some embodiments, the cleavage site is defined based on the distance of the two nucleotides from the PAM on the positive (+) strand of the polynucleotide and the distance of the two nucleotides from the PAM on the negative (−) strand of the polynucleotide.

RGDBPs and RGNs can be used to deliver a fused polypeptide, polynucleotide, or small molecule payload to a particular genomic location.

In those embodiments wherein the DNA-binding polypeptide comprises a meganuclease, a target sequence can comprise a pair of inverted, 9 basepair "half sites" which are separated by four basepairs. In the case of a single-chain meganuclease, the N-terminal domain of the protein contacts a first half-site and the C-terminal domain of the protein contacts a second half-site. Cleavage by a meganuclease produces four basepair 3' overhangs. In those embodiments wherein the DNA-binding polypeptide comprises a compact TALEN, the recognition sequence comprises a first CNNNGN sequence that is recognized by the I-TevI domain, followed by a non-specific spacer 4-16 basepairs in length, followed by a second sequence 16-22 bp in length that is recognized by the TAL-effector domain (this sequence typically has a 5' T base). In those embodiments wherein the DNA-binding polypeptide comprises a zinc finger, the DNA binding domains typically recognize an 18-bp recognition sequence comprising a pair of nine basepair "half-sites" separated by 2-10 basepairs and cleavage by the nuclease creates a blunt end or a 5' overhang of variable length (frequently four basepairs).

IV. Fusion Proteins

In some embodiments, a DNA-binding polypeptide (e.g., nuclease-inactive or a nickase RGN) is operably linked to a deaminase of the invention. In some embodiments, a DNA-binding polypeptide (e.g., nuclease inactive RGN or nickase RGN) fused to a deaminase of the invention can be targeted to a particular location of a nucleic acid molecule (i.e., target nucleic acid molecule), which in some embodiments is a particular genomic locus, to alter the expression of a desired sequence. In some embodiments, the binding of a fusion protein to a target sequence results in deamination of a nucleobase, resulting in conversion from one nucleobase to another. In some embodiments, the binding of this fusion protein to a target sequence results in deamination of a nucleobase adjacent to the target sequence. The nucleobase adjacent to the target sequence that is deaminated and mutated using the presently disclosed compositions and methods may be 1, 2, 3, 4, 5, 6, 7, 8, 9, 10, 11, 12, 13, 14, 15, 16, 17, 18, 19, 20, 25, 30, 35, 40, 45, 50, 55, 60, 65, 70, 75, 80, 85, 90, 95, or 100 base pairs from the 5' or 3' end of the target sequence (bound by the gRNA) within the target nucleic acid molecule. Some aspects of this disclosure provide fusion proteins comprising (i) a DNA-binding polypeptide (e.g., a nuclease-inactive or nickase RGN polypeptide); (ii) a deaminase polypeptide; and optionally (iii) a second deaminase. The second deaminase may be the same deaminase as the first or may be a different deaminase. In some embodiments, both the first and the second deaminase are adenine deaminases of the invention.

The instant disclosure provides fusion proteins of various configurations. In some embodiments, the deaminase polypeptide is fused to the N-terminus of the DNA-binding polypeptide (e.g., RGN polypeptide). In some embodiments, the deaminase polypeptide is fused to the C-terminus of the DNA-binding polypeptide (e.g., RGN polypeptide).

In some embodiments, the deaminase and DNA-binding polypeptide (e.g., RNA-guided, DNA-binding polypeptide) are fused to each other via a peptide linker. The linker between the deaminase and DNA-binding polypeptide (e.g., RNA-guided, DNA-binding polypeptide) can determine the editing window of the fusion protein, thereby increasing deaminase specificity and reducing off-target mutations. Various linker lengths and flexibilities can be employed, ranging from very flexible linkers of the form $(GGGGS)_n$ and $(G)_n$ to more rigid linkers of the form $(EAAAK)_n$ and $(XP)_n$, to achieve the optimal length and rigidity for deaminase activity for the specific applications. The term "linker," as used herein, refers to a chemical group or a molecule linking two molecules or moieties, e.g., a binding domain and a cleavage domain of a nuclease. In some embodiments, a linker joins an RNA guided nuclease and a deaminase. In some embodiments, a linker joins a dead or inactive RGN and a deaminase. In further embodiments, a linker joins two deaminases. Typically, the linker is positioned between, or flanked by, two groups, molecules, or other moieties and connected to each one via a covalent bond, thus connecting the two. In some embodiments, the linker is an amino acid or a plurality of amino acids (e.g., a peptide or protein). In some embodiments, the linker is an organic molecule, group, polymer, or chemical moiety. In some embodiments, the linker is 3-100 amino acids in length, for example, 3, 4, 5, 6, 7, 8, 9, 10, 11, 12, 13, 14, 15, 16, 17, 18, 19, 20, 21, 22, 23, 24, 25, 26, 27, 28, 29, 30, 30-35, 35-40, 40-45, 45-50, 50-60, 60-70, 70-80, 80-90, 90-100, 100-150, or 150-200 amino acids in length. Longer or shorter linkers are also contemplated. In some embodiments, a shorter linker is preferred to decrease the overall size or length of the fusion protein or its coding sequence.

In some embodiments, the linker comprises a $(GGGGS)_n$, a $(G)_n$ an $(EAAAK)_n$, or an $(XP)_n$ motif, or a combination of any of these, wherein n is independently an integer between 1 and 30. In some embodiments, n is independently 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30, or, if more than one linker or more than one linker motif is present, any combination thereof. Additional suitable linker motifs and linker configurations will be apparent to those of skill in the art. In some embodiments, suitable linker motifs and configurations include those described in Chen et al., 2013 (*Adv Drug Deliv Rev.* 65(10):1357-69, the entire contents of which are incorporated herein by reference). Additional suitable linker sequences will be apparent to those of skill in the art. In some embodiments, the linker sequence comprises the amino acid sequence set forth as SEQ ID NO: 45 or 442.

In some embodiments, the general architecture of exemplary fusion proteins provided herein comprises the structure: [NH$_2$]-[deaminase]-[DBP]-[COOH]; [NH$_2$]-[DBP]-[deaminase]-[COOH]; [NH$_2$]-[DBP]-[deaminase]-[deaminase]-[COOH]; [NH$_2$]-[deaminase]-[DBP]-[deaminase]-[COOH]; or [NH$_2$]-[deaminase]-[deaminase]-[DBP]-[COOH], wherein DBP is a DNA-binding polypeptide, NH$_2$ is the N-terminus of the fusion protein and COOH is the C-terminus of the fusion protein. In some embodiments, the fusion protein comprises more than two deaminase polypeptides.

In certain embodiments, the general architecture of exemplary fusion proteins provided herein comprises the structure: [NH$_2$]-[deaminase]-[RGN]-[COOH]; [NH$_2$]-[RGN]-[deaminase]-[COOH]; [NH$_2$]-[RGN]-[deaminase]-[deaminase]-[COOH]; [NH$_2$]-[deaminase]-[RGN]-[deaminase]-[COOH]; or [NH$_2$]-[deaminase]-[deaminase]-[RGN]-[COOH], wherein NH$_2$ is the N-terminus of the fusion protein and COOH is the C-terminus of the fusion protein. In some embodiments, the fusion protein comprises more than two deaminase polypeptides.

In some embodiments, the fusion protein comprises the structure: [NH$_2$]-[deaminase]-[nuclease-inactive RGN]-[COOH]; [NH$_2$]-[deaminase]-[deaminase]-[nuclease-inactive RGN]-[COOH]; [NH$_2$]-[nuclease-inactive RGN]-[deaminase]-[COOH]; [NH$_2$]-[deaminase]-[nuclease-inactive RGN]-[deaminase]-[COOH]; or [NH$_2$]-[nuclease-inactive RGN]-[deaminase]-[deaminase]-[COOH]. It should be understood that "nuclease-inactive RGN" represents any RGN, including any CRISPR-Cas protein, which has been mutated to be nuclease-inactive. In some embodiments, the fusion protein comprises more than two deaminase polypeptides.

In some embodiments, the fusion protein comprises the structure: [NH$_2$]-[deaminase]-[RGN nickase]-[COOH]; [NH$_2$]-[deaminase]-[deaminase]-[RGN nickase]-[COOH]; [NH$_2$]-[RGN nickase]-[deaminase]-[COOH]; [NH$_2$]-[deaminase]-[RGN nickase]-[deaminase]-[COOH]; or [NH$_2$]-[RGN nickase]-[deaminase]-[deaminase]-[COOH]. It should be understood that "RGN nickase" represents any RGN, including any CRISPR-Cas protein, which has been mutated to be active as a nickase.

In some embodiments, the "-" used in the general architecture above indicates the presence of an optional linker sequence. In some embodiments, the fusion proteins provided herein do not comprise a linker sequence. In some embodiments, at least one of the optional linker sequences are present.

Other exemplary features that may be present are localization sequences, such as nuclear localization sequences, cytoplasmic localization sequences, export sequences, such as nuclear export sequences, or other localization sequences, as well as sequence tags that are useful for solubilization, purification or detection of the fusion proteins. Suitable localization signal sequences and sequences of protein tags that are provided herein, and include, but are not limited to, biotin carboxylase carrier protein (BCCP) tags, myc-tags, calmodulin-tags, FLAG-tags, hemagglutinin (HA)-tags, polyhistidine tags, also referred to as histidine tags or His-tags, maltose binding protein (MBP)-tags, nus-tags, glutathione-S-transferase (GST)-tags, green fluorescent protein (GFP)-tags, thioredoxin-tags, S-tags, Softags (e.g., Softag 1, Softag 3), streptags, biotin ligase tags, FlAsH tags, V5 tags, and SBP-tags. Additional suitable sequences will be apparent to those of skill in the art.

In certain embodiments, the presently disclosed fusion proteins comprise at least one cell-penetrating domain that facilitates cellular uptake of the fusion protein. Cell-penetrating domains are known in the art and generally comprise stretches of positively charged amino acid residues (i.e., polycationic cell-penetrating domains), alternating polar amino acid residues and non-polar amino acid residues (i.e., amphipathic cell-penetrating domains), or hydrophobic amino acid residues (i.e., hydrophobic cell-penetrating domains) (see, e.g., Milletti F. (2012) *Drug Discov Today* 17:850-860). A non-limiting example of a cell-penetrating domain is the trans-activating transcriptional activator (TAT) from the human immunodeficiency virus 1.

In some embodiments, deaminases or fusion proteins provided herein further comprise a nuclear localization sequence (NLS). The nuclear localization signal, plastid localization signal, mitochondrial localization signal, dual-targeting localization signal, and/or cell-penetrating domain can be located at the amino-terminus (N-terminus), the carboxyl-terminus (C-terminus), or in an internal location of the fusion protein.

In some embodiments, the NLS is fused to the N-terminus of the fusion protein or deaminase. In some embodiments, the NLS is fused to the C-terminus of the fusion protein or deaminase. In some embodiments, the NLS is fused to the N-terminus of the deaminase of the fusion protein. In some embodiments, the NLS is fused to the C-terminus of the deaminase of the fusion protein. In some embodiments, the NLS is fused to the N-terminus of the DNA-binding polypeptide (e.g., RGN polypeptide) of the fusion protein. In some embodiments, the NLS is fused to the C-terminus of the DNA-binding polypeptide (e.g., RGN polypeptide) of the fusion protein. In some embodiments, the NLS is fused to the N-terminus of the deaminase polypeptide of the fusion protein. In some embodiments, the NLS is fused to the C-terminus of the deaminase polypeptide of the fusion protein. In some embodiments, the NLS is fused to the fusion protein via one or more linkers. In some embodiments, the NLS is fused to the fusion protein without a linker. In some embodiments, the NLS comprises an amino acid sequence of any one of the NLS sequences provided or referenced herein. In some embodiments, the NLS comprises an amino acid sequence as set forth in SEQ ID NO: 43 or SEQ ID NO: 46. In some embodiments, the fusion protein or deaminase comprises SEQ ID NO: 43 on its N-terminus and SEQ ID NO: 46 on its C-terminus.

In some embodiments, fusion proteins as provided herein comprise the full-length sequence of a deaminase, e.g., any one of SEQ ID NO: 1-10 and 399-441. In some embodiments, however, fusion proteins as provided herein do not comprise a full-length sequence of a deaminase, but only a fragment thereof. For example, in some embodiments, a fusion protein provided herein further comprises a DNA-binding polypeptide (e.g., an RNA-guided, DNA-binding) domain and a deaminase domain.

In some embodiments, a fusion protein of the invention comprises a DNA-binding polypeptide (e.g., an RGN) and a deaminase, wherein the deaminase has an amino acid sequence having at least 50%, at least 55%, at least 60%, at least 65%, at least 70%, at least 75%, at least 80%, at least 85%, at least 90%, at least 95%, at least 96%, at least 97%, at least 98%, at least 99%, or 100% identity to any of SEQ ID NOs: 1-10 and 399-441. Examples of such fusion proteins are described in the Examples section herein.

In some embodiments, the fusion protein comprises one deaminase polypeptide. In some embodiments, the fusion protein comprises at least two deaminase polypeptides, operably linked either directly or via a peptide linker. In some embodiments, the fusion protein comprises one deaminase polypeptide, and a second deaminase polypeptide is co-expressed with the fusion protein.

Also provided herein is a ribonucleoprotein complex comprising a fusion protein comprising a deaminase and an RGDBP and the guide RNA, either as a single guide or as a dual guide RNA (also collectively referred to as gRNA).

V. Nucleotides Encoding Deaminases, Fusion Proteins, and/or gRNA

The present disclosure provides polynucleotides (SEQ ID NOs: 11-20 and 443-485) encoding the presently disclosed deaminase polypeptides. The present disclosure further provides polynucleotides encoding for fusion proteins which comprise a deaminase and DNA-binding polypeptide, for example a meganuclease, a zinc finger fusion protein, or a TALEN. The present disclosure further provides polynucleotides encoding for fusion proteins which comprise a deaminase domain and an RNA-guided, DNA-binding polypeptide. Such RNA-guided, DNA-binding polypeptides may be an RGN or RGN variant. The protein variant may be a nuclease-inactive or a nickase. The RGN may be a CRISPR-Cas protein or active variant or fragment thereof. SEQ ID NOs: 41 and 42 are non-limiting examples of an RGN and a nickase RGN variant, respectively. Examples of CRISPR-Cas nucleases are well-known in the art, and similar corresponding mutations can create mutant variants which are also nickases or are nuclease inactive.

An embodiment of the invention provides a polynucleotide encoding a fusion protein which comprises an RGDBP and a deaminase described herein (SEQ ID NO: 1-10 and 399-441, or a variant thereof). In some embodiments, a second polynucleotide encodes the guide RNA required by the RGDBP for targeting to the nucleotide sequence of interest. In some embodiments, the guide RNA and the fusion protein are encoded by the same polynucleotide.

The use of the term "polynucleotide" is not intended to limit the present disclosure to polynucleotides comprising DNA, though such DNA polynucleotides are contemplated. Those of ordinary skill in the art will recognize that polynucleotides can comprise ribonucleotides (RNA) and combinations of ribonucleotides and deoxyribonucleotides. Such deoxyribonucleotides and ribonucleotides include both naturally occurring molecules and synthetic analogues. The polynucleotides disclosed herein also encompass all forms of sequences including, but not limited to, single-stranded forms, double-stranded forms, stem-and-loop structures, circular forms (e.g., including circular RNA), and the like.

An embodiment of the invention is a nucleic acid molecule comprising a sequence having at least 50%, at least 55%, at least 60%, at least 65%, at least 70%, at least 75%, at least 80%, at least 85%, at least 90%, at least 95%, at least 96%, at least 97%, at least 98%, at least 99% or 100% identity to any of SEQ ID NOs: 11-20 and 443-485, wherein the nucleic acid molecule encodes a deaminase having adenine deaminase activity. The nucleic acid molecule may further comprise a heterologous promoter or terminator. The nucleic acid molecule may encode a fusion protein, where the encoded deaminase is operably linked to a DNA-binding polypeptide, and optionally a second deaminase. In some embodiments, the nucleic acid molecule encodes a fusion protein, where the encoded deaminase is operably linked to an RGN and optionally a second deaminase.

In some embodiments, nucleic acid molecules comprising a polynucleotide which encodes a deaminase of the invention are codon optimized for expression in an organism of interest. A "codon-optimized" coding sequence is a polynucleotide coding sequence having its frequency of codon usage designed to mimic the frequency of preferred codon usage or transcription conditions of a particular host cell. Expression in the particular host cell or organism is enhanced as a result of the alteration of one or more codons at the nucleic acid level such that the translated amino acid sequence is not changed. Nucleic acid molecules can be codon optimized, either wholly or in part. Codon tables and other references providing preference information for a wide range of organisms are available in the art (see, e.g., Campbell and Gown (1990) Plant Physiol. 92:1-11 for a discussion of plant-preferred codon usage). Methods are available in the art for synthesizing plant-preferred genes. See, for example, U.S. Pat. Nos. 5,380,831, and 5,436,391, and Murray et al. (1989) *Nucleic Acids Res.* 17:477-498, herein incorporated by reference.

In some embodiments, polynucleotides encoding the deaminases, fusion proteins, and/or gRNAs described herein are provided in expression cassettes for in vitro expression or expression in a cell, organelle, embryo, or organism of interest. The cassette may include 5' and 3' regulatory sequences operably linked to a polynucleotide encoding a deaminase and/or a fusion protein comprising a deaminase, an RNA-guided DNA-binding polypeptide and optionally a second deaminase, and/or gRNA provided herein that allows for expression of the polynucleotide. The cassette may additionally contain at least one additional gene or genetic element to be cotransformed into the organism. Where additional genes or elements are included, the components are operably linked. The term "operably linked" is intended to mean a functional linkage between two or more elements. For example, an operable linkage between a promoter and a coding region of interest (e.g., a region coding for a deaminase, RNA-guided DNA-binding polypeptide, and/or gRNA) is a functional link that allows for expression of the coding region of interest. Operably linked elements may be contiguous or non-contiguous. When used to refer to the joining of two protein coding regions, by operably linked is intended that the coding regions are in the same reading frame. In some embodiments, the additional gene(s) or element(s) are provided on multiple expression cassettes. For example, the nucleotide sequence encoding a presently disclosed deaminase, either alone or as a component of a fusion protein, can be present on one expression cassette, whereas the nucleotide sequence encoding a gRNA can be on a separate expression cassette. Another example may have the nucleotide sequence encoding a presently disclosed deaminase alone on a first expression cassette, a second expression cassette encoding a fusion protein comprising a deaminase, and a nucleotide sequence encoding a gRNA on third expression cassette. Such an expression cassette is provided with a plurality of restriction sites and/or recombination sites for insertion of the polynucleotides to be under the transcriptional regulation of the regulatory regions. Expression cassettes which comprise a selectable marker gene may also be present.

The expression cassette may include in the 5'-3' direction of transcription, a transcriptional (and, in some embodiments, translational) initiation region (i.e., a promoter), a deaminase-encoding polynucleotide of the invention, and a transcriptional (and in some embodiments, translational) termination region (i.e., termination region) functional in the organism of interest. The promoters of the invention are capable of directing or driving expression of a coding sequence in a host cell. The regulatory regions (e.g., promoters, transcriptional regulatory regions, and translational termination regions) may be endogenous or heterologous to the host cell or to each other. As used herein, "heterologous" in reference to a sequence is a sequence that originates from a foreign species, or, if from the same species, is substantially modified from its native form in composition and/or genomic locus by deliberate human intervention. As used herein, a chimeric gene comprises a coding sequence operably linked to a transcription initiation region that is heterologous to the coding sequence.

Convenient termination regions are available from the Ti-plasmid of *A. tumefaciens*, such as the octopine synthase and nopaline synthase termination regions. See also Guerineau et al. (1991) *Mol. Gen. Genet.* 262:141-144; Proudfoot (1991) *Cell* 64:671-674; Sanfacon et al. (1991) *Genes Dev.* 5:141-149; Mogen et al. (1990) *Plant Cell* 2:1261-1272; Munroe et al. (1990) *Gene* 91:151-158; Ballas et al. (1989) *Nucleic Acids Res.* 17:7891-7903; and Joshi et al. (1987) *Nucleic Acids Res.* 15:9627-9639.

Additional regulatory signals include, but are not limited to, transcriptional initiation start sites, operators, activators, enhancers, other regulatory elements, ribosomal binding sites, an initiation codon, termination signals, and the like. See, for example, U.S. Pat. Nos. 5,039,523 and 4,853,331; EPO 0480762A2; Sambrook et al. (1992) Molecular Cloning: A Laboratory Manual, ed. Maniatis et al. (Cold Spring Harbor Laboratory Press, Cold Spring Harbor, N.Y.), hereinafter "Sambrook 11"; Davis et al., eds. (1980) Advanced Bacterial Genetics (Cold Spring Harbor Laboratory Press), Cold Spring Harbor, N.Y., and the references cited therein.

In preparing the expression cassette, the various DNA fragments may be manipulated, so as to provide for the DNA sequences in the proper orientation and, as appropriate, in the proper reading frame. Toward this end, adapters or linkers may be employed to join the DNA fragments or other manipulations may be involved to provide for convenient restriction sites, removal of superfluous DNA, removal of restriction sites, or the like. For this purpose, in vitro mutagenesis, primer repair, restriction, annealing, resubstitutions, e.g., transitions and transversions, may be involved.

A number of promoters can be used in the practice of the invention. The promoters can be selected based on the desired outcome. The nucleic acids can be combined with constitutive, inducible, growth stage-specific, cell type-specific, tissue-preferred, tissue-specific, or other promoters for expression in the organism of interest. See, for example, promoters set forth in WO 99/43838 and in U.S. Pat. Nos. 8,575,425; 7,790,846; 8,147,856; 8,586,832; 7,772,369; 7,534,939; 6,072,050; 5,659,026; 5,608,149; 5,608,144; 5,604,121; 5,569,597; 5,466,785; 5,399,680; 5,268,463; 5,608,142; and 6,177,611; herein incorporated by reference.

For expression in plants, constitutive promoters also include CaMV 35S promoter (Odell et al. (1985) *Nature* 313:810-812); rice actin (McElroy et al. (1990) *Plant Cell* 2:163-171); ubiquitin (Christensen et al. (1989) *Plant Mol. Biol.* 12:619-632 and Christensen et al. (1992) *Plant Mol. Biol.* 18:675-689); pEMU (Last et al. (1991) *Theor. Appl. Genet.* 81:581-588); and MAS (Velten et al. (1984) *EMBO J.* 3:2723-2730).

Examples of inducible promoters are the Adh1 promoter which is inducible by hypoxia or cold stress, the Hsp70 promoter which is inducible by heat stress, the PPDK promoter and the pepcarboxylase promoter which are both inducible by light. Also useful are promoters which are chemically inducible, such as the In2-2 promoter which is safener induced (U.S. Pat. No. 5,364,780), the Axig1 promoter which is auxin induced and tapetum specific but also active in callus (PCT US01/22169), the steroid-responsive promoters (see, for example, the ERE promoter which is estrogen induced, and the glucocorticoid-inducible promoter in Schena et al. (1991) *Proc. Natl. Acad. Sci. USA* 88:10421-10425 and McNellis et al. (1998) *Plant J.* 14(2):247-257) and tetracycline-inducible and tetracycline-repressible promoters (see, for example, Gatz et al. (1991) *Mol. Gen. Genet.* 227:229-237, and U.S. Pat. Nos. 5,814,618 and 5,789,156), herein incorporated by reference.

In some embodiments, tissue-specific or tissue-preferred promoters are utilized to target expression of an expression construct within a particular tissue. In certain embodiments, the tissue-specific or tissue-preferred promoters are active in plant tissue. Examples of promoters under developmental control in plants include promoters that initiate transcription preferentially in certain tissues, such as leaves, roots, fruit, seeds, or flowers. A "tissue specific" promoter is a promoter that initiates transcription only in certain tissues. Unlike constitutive expression of genes, tissue-specific expression is the result of several interacting levels of gene regulation. As such, promoters from homologous or closely related plant species can be preferable to use to achieve efficient and reliable expression of transgenes in particular tissues. In some embodiments, the expression comprises a tissue-preferred promoter. A "tissue preferred" promoter is a promoter that initiates transcription preferentially, but not necessarily entirely or solely in certain tissues.

In some embodiments, the nucleic acid molecules encoding a deaminase described herein comprise a cell type-specific promoter. A "cell type specific" promoter is a promoter that primarily drives expression in certain cell types in one or more organs. Some examples of plant cells in which cell type specific promoters functional in plants may be primarily active include, for example, BETL cells, vascular cells in roots, leaves, stalk cells, and stem cells. The nucleic acid molecules can also include cell type preferred promoters. A "cell type preferred" promoter is a promoter that primarily drives expression mostly, but not necessarily entirely or solely in certain cell types in one or more organs. Some examples of plant cells in which cell type preferred promoters functional in plants may be preferentially active include, for example, BETL cells, vascular cells in roots, leaves, stalk cells, and stem cells.

In some embodiments, the nucleic acid sequences encoding the deaminases, fusion proteins, and/or gRNAs are operably linked to a promoter sequence that is recognized by a phage RNA polymerase for example, for in vitro mRNA synthesis. In such embodiments, the in vitro-transcribed RNA can be purified for use in the methods described herein. For example, the promoter sequence can be a T7, T3, or SP6 promoter sequence or a variation of a T7, T3, or SP6 promoter sequence. In such embodiments, the expressed protein and/or RNAs can be purified for use in the methods of genome modification described herein.

In certain embodiments, the polynucleotide encoding the deaminase, fusion protein, and/or gRNA is linked to a polyadenylation signal (e.g., SV40 polyA signal and other signals functional in plants) and/or at least one transcriptional termination sequence. In some embodiments, the sequence encoding the deaminase or fusion protein is linked to sequence(s) encoding at least one nuclear localization signal, at least one cell-penetrating domain, and/or at least one signal peptide capable of trafficking proteins to particular subcellular locations, as described elsewhere herein.

In some embodiments, the polynucleotide encoding the deaminase, fusion protein, and/or gRNA is present in a vector or multiple vectors. A "vector" refers to a polynucleotide composition for transferring, delivering, or introducing a nucleic acid into a host cell. Suitable vectors include plasmid vectors, phagemids, cosmids, artificial/mini-chromosomes, transposons, and viral vectors (e.g., lentiviral vectors, adeno-associated viral vectors, baculoviral vector). In some embodiments, the vector comprises additional expression control sequences (e.g., enhancer sequences, Kozak sequences, polyadenylation sequences, transcriptional termination sequences), selectable marker sequences (e.g., antibiotic resistance genes), origins of replication, and the like. Additional information can be found in "Current Protocols in Molecular Biology" Ausubel et al., John Wiley & Sons, New York, 2003 or "Molecular Cloning: A Laboratory Manual" Sambrook & Russell, Cold Spring Harbor Press, Cold Spring Harbor, N.Y., 3rd edition, 2001.

In some embodiments, the vector comprises a selectable marker gene for the selection of transformed cells. Selectable marker genes are utilized for the selection of transformed cells or tissues. Marker genes include genes encoding antibiotic resistance, such as those encoding neomycin phosphotransferase II (NEO) and hygromycin phosphotransferase (HPT), as well as genes conferring resistance to herbicidal compounds, such as glufosinate ammonium, bromoxynil, imidazolinones, and 2,4-dichlorophenoxyacetate (2,4-D).

In some embodiments, the expression cassette or vector comprising the sequence encoding a fusion protein comprising an RNA-guided DNA-binding polypeptide, such as an RGN, further comprises a sequence encoding a gRNA. In some embodiments, the sequence(s) encoding the gRNA are operably linked to at least one transcriptional control sequence for expression of the gRNA in the organism or host cell of interest. For example, the polynucleotide encoding the gRNA can be operably linked to a promoter sequence that is recognized by RNA polymerase III (Pol III). Examples of suitable Pol III promoters include, but are not limited to, mammalian U6, U3, H1, and 7SL RNA promoters and rice U6 and U3 promoters.

As indicated, expression constructs comprising nucleotide sequences encoding the deaminases, fusion proteins, and/or gRNAs can be used to transform organisms of interest. Methods for transformation involve introducing a nucleotide construct into an organism of interest. By "introducing" is intended to introduce the nucleotide construct to the host cell in such a manner that the construct gains access to the interior of the host cell. The methods of the invention do not require a particular method for introducing a nucleotide construct to a host organism, only that the nucleotide construct gains access to the interior of at least one cell of the host organism. The host cell can be a eukaryotic or prokaryotic cell. In particular embodiments, the eukaryotic host cell is a plant cell, a mammalian cell, or an insect cell. Methods for introducing nucleotide constructs into plants and other host cells are known in the art including, but not limited to, stable transformation methods, transient transformation methods, and virus-mediated methods.

The methods result in a transformed organism, such as a plant, including whole plants, as well as plant organs (e.g., leaves, stems, roots, etc.), seeds, plant cells, propagules, embryos and progeny of the same. Plant cells can be differentiated or undifferentiated (e.g. callus, suspension culture cells, protoplasts, leaf cells, root cells, phloem cells, pollen).

"Transgenic organisms" or "transformed organisms" or "stably transformed" organisms or cells or tissues refers to organisms that have incorporated or integrated a polynucleotide encoding a deaminase of the invention. It is recognized that other exogenous or endogenous nucleic acid sequences or DNA fragments may also be incorporated into the host cell. *Agrobacterium*—and biolistic-mediated transformation remain the two predominantly employed approaches for transformation of plant cells. However, transformation of a host cell may be performed by infection, transfection, microinjection, electroporation, microprojection, biolistics or particle bombardment, electroporation, silica/carbon fibers, ultrasound mediated, PEG mediated, calcium phosphate co-precipitation, polycation DMSO technique, DEAE dextran procedure, and viral mediated, liposome mediated and the like. Viral-mediated introduction of a polynucleotide encoding a deaminase, fusion protein, and/or gRNA includes retroviral, lentiviral, adenoviral, and adeno-associated viral mediated introduction and expression, as well as the use of Cauliviruses (e.g., cauliflower mosaic virus), Geminiviruses (e.g., bean golden yellow mosaic virus or maize streak virus), and RNA plant viruses (e.g., tobacco mosaic virus).

Transformation protocols as well as protocols for introducing polypeptides or polynucleotide sequences into plants may vary depending on the type of host cell (e.g., monocot or dicot plant cell) targeted for transformation. Methods for transformation are known in the art and include those set forth in U.S. Pat. Nos. 8,575,425; 7,692,068; 8,802,934; 7,541,517; each of which is herein incorporated by reference. See, also, Rakoczy-Trojanowska, M. (2002) *Cell Mol Biol Lett.* 7:849-858; Jones et al. (2005) *Plant Methods* 1:5; Rivera et al. (2012) *Physics of Life Reviews* 9:308-345; Bartlett et al. (2008) *Plant Methods* 4:1-12; Bates, G. W. (1999) *Methods in Molecular Biology* 111:359-366; Binns and Thomashow (1988) *Annual Reviews in Microbiology* 42:575-606; Christou, P. (1992) *The Plant Journal* 2:275-281; Christou, P. (1995) *Euphytica* 85:13-27; Tzfira et al. (2004) *TRENDS in Genetics* 20:375-383; Yao et al. (2006) *Journal of Experimental Botany* 57:3737-3746; Zupan and Zambryski (1995) *Plant Physiology* 107:1041-1047; Jones et al. (2005) *Plant Methods* 1:5;

Transformation may result in stable or transient incorporation of the nucleic acid into the cell. "Stable transformation" is intended to mean that the nucleotide construct introduced into a host cell integrates into the genome of the host cell and is capable of being inherited by the progeny thereof. "Transient transformation" is intended to mean that a polynucleotide is introduced into the host cell and does not integrate into the genome of the host cell.

Methods for transformation of chloroplasts are known in the art. See, for example, Svab et al. (1990) *Proc. Natl. Acad. Sci. USA* 87:8526-8530; Svab and Maliga (1993) *Proc. Natl. Acad. Sci. USA* 90:913-917; Svab and Maliga (1993) *EMBO J.* 12:601-606. The method relies on particle gun delivery of DNA containing a selectable marker and targeting of the DNA to the plastid genome through homologous recombination. Additionally, plastid transformation can be accomplished by transactivation of a silent plastid-borne transgene by tissue-preferred expression of a nuclear-encoded and plastid-directed RNA polymerase. Such a system has been reported in McBride et al. (1994) *Proc. Natl. Acad. Sci. USA* 91:7301-7305.

The cells that have been transformed may be grown into a transgenic organism, such as a plant, in accordance with conventional ways. See, for example, McCormick et al. (1986) *Plant Cell Reports* 5:81-84. These plants may then be grown, and either pollinated with the same transformed strain or different strains, and the resulting hybrid having the deaminase or fusion protein polynucleotide identified. Two or more generations may be grown to ensure that the deaminase or fusion protein polynucleotide is stably maintained and inherited and the seeds harvested to ensure the presence of the deaminase or fusion protein polynucleotide. In this manner, the present invention provides transformed seed (also referred to as "transgenic seed") having a nucleotide construct of the invention, for example, an expression cassette of the invention, stably incorporated into their genome.

In some embodiments, cells that have been transformed are introduced into an organism. These cells could have originated from the organism, wherein the cells are transformed in an ex vivo approach.

The sequences provided herein may be used for transformation of any plant species, including, but not limited to, monocots and dicots. Examples of plants of interest include, but are not limited to, corn (maize), sorghum, wheat, sunflower, tomato, crucifers, peppers, potato, cotton, rice, soybean, sugarbeet, sugarcane, tobacco, barley, and oilseed rape, *Brassica* sp., alfalfa, rye, millet, safflower, peanuts, sweet potato, cassava, coffee, coconut, pineapple, citrus trees, cocoa, tea, banana, avocado, fig, guava, mango, olive, papaya, cashew, macadamia, almond, oats, vegetables, ornamentals, and conifers.

Vegetables include, but are not limited to, tomatoes, lettuce, green beans, lima beans, peas, and members of the genus *Curcumis* such as cucumber, cantaloupe, and musk melon. Ornamentals include, but are not limited to, azalea, hydrangea, hibiscus, roses, tulips, daffodils, petunias, carnation, poinsettia, and chrysanthemum. Preferably, plants of the present invention are crop plants (for example, maize, sorghum, wheat, sunflower, tomato, crucifers, peppers, potato, cotton, rice, soybean, sugarbeet, sugarcane, tobacco, barley, oilseed rape, etc.).

As used herein, the term plant includes plant cells, plant protoplasts, plant cell tissue cultures from which plants can be regenerated, plant calli, plant clumps, and plant cells that are intact in plants or parts of plants such as embryos, pollen, ovules, seeds, leaves, flowers, branches, fruit, kernels, ears, cobs, husks, stalks, roots, root tips, anthers, and the like. Grain is intended to mean the mature seed produced by commercial growers for purposes other than growing or reproducing the species. Progeny, variants, and mutants of the regenerated plants are also included within the scope of the invention, provided that these parts comprise the introduced polynucleotides. Further provided is a processed plant product or byproduct that retains the sequences disclosed herein, including for example, soymeal.

In some embodiments, the polynucleotides encoding the deaminases, fusion proteins, and/or gRNAs are used to transform any eukaryotic species, including but not limited to animals (e.g., mammals, insects, fish, birds, and reptiles), fungi, amoeba, algae, and yeast. In some embodiments, the polynucleotides encoding the deaminases, fusion proteins, and/or gRNAs are used to transform any prokaryotic species, including but not limited to, archaea and bacteria (e.g., *Bacillus* spp., *Klebsiella* spp. *Streptomyces* spp., *Rhizobium* spp., *Escherichia* spp., *Pseudomonas* spp., *Salmonella* spp., *Shigella* spp., *Vibrio* spp., *Yersinia* spp., *Mycoplasma* spp., *Agrobacterium* spp., and *Lactobacillus* spp.).

In some embodiments, conventional viral and non-viral based gene transfer methods are used to introduce nucleic acids in mammalian cells or target tissues. Such methods can be used to administer nucleic acids encoding a deaminase or fusion protein of the invention and optionally a gRNA to cells in culture, or in a host organism. Non-viral vector delivery systems include DNA plasmids, RNA (e.g., a transcript of a vector described herein), naked nucleic acid, and nucleic acid complexed with a delivery vehicle, such as a liposome. Viral vector delivery systems include DNA and RNA viruses, which have either episomal or integrated genomes after delivery to the cell. Non-limiting examples include vectors utilizing Caulimoviruses (e.g., cauliflower mosaic virus), Geminiviruses (e.g., bean golden yellow mosaic virus or maize steak virus), and RNA plant viruses (e.g., tobacco mosaic virus). For a review of gene therapy procedures, see Anderson, *Science* 256: 808-813 (1992); Nabel & Feigner, *TIBTECH* 11:211-217 (1993); Mitani & Caskey, *TIBTECH* 11:162-166 (1993); Dillon, *TIBTECH* 11:167-175 (1993); Miller, *Nature* 357:455-460 (1992); Van Brunt, *Biotechnology* 6(10): 1149-1154 (1988); Vigne, *Restorative Neurology and Neuroscience* 8:35-36 (1995); Kremer & Perricaudet, *British Medical Bulletin* 51(1):31-44 (1995); Haddada et al., in Current Topics in Microbiology and Immunology, Doerfler and Bohm (eds) (1995); and Yu et al., *Gene Therapy* 1:13-26 (1994).

Methods of non-viral delivery of nucleic acids include lipofection, *Agrobacterium*-mediated transformation, nucleofection, microinjection, biolistics, virosomes, liposomes, immunoliposomes, polycation or lipid: nucleic acid conjugates, naked DNA, artificial virions, and agent-enhanced uptake of DNA. Lipofection is described in e.g., U.S. Pat. Nos. 5,049,386, 4,946,787; and 4,897,355) and lipofection reagents are sold commercially (e.g., Transfectam™ and Lipofectin™). Cationic and neutral lipids that are suitable for efficient receptor-recognition lipofection of polynucleotides include those of Feigner, WO 91/17424; WO 91/16024. Delivery can be to cells (e.g. in vitro or ex vivo administration) or target tissues (e.g. in vivo administration). The preparation of lipid:nucleic acid complexes, including targeted liposomes such as immunolipid complexes, is well known to one of skill in the art (see, e.g., Crystal, *Science* 270:404-410 (1995); Blaese et al., *Cancer Gene Ther.* 2:291-297 (1995); Behr et al., *Bioconjugate Chem.* 5:382-389 (1994); Remy et al., *Bioconjugate Chem.* 5:647-654 (1994); Gao et al., *Gene Therapy* 2:710-722 (1995); Ahmad et al., *Cancer Res.* 52:4817-4820 (1992); U.S. Pat. Nos. 4,186, 183, 4,217,344, 4,235,871, 4,261,975, 4,485,054, 4,501,728, 4,774,085, 4,837,028, and 4,946,787).

The use of RNA or DNA viral based systems for the delivery of nucleic acids takes advantage of highly evolved processes for targeting a virus to specific cells in the body and trafficking the viral payload to the nucleus. Viral vectors can be administered directly to patients (in vivo) or they can be used to treat cells in vitro, and the modified cells may optionally be administered to patients (ex vivo). Conventional viral based systems could include retroviral, lentivirus, adenoviral, adeno-associated and herpes simplex virus vectors for gene transfer. Integration in the host genome is possible with the retrovirus, lentivirus, and adeno-associated virus gene transfer methods, often resulting in long term expression of the inserted transgene. Additionally, high transduction efficiencies have been observed in many different cell types and target tissues.

The tropism of a retrovirus can be altered by incorporating foreign envelope proteins, expanding the potential target population of target cells. Lentiviral vectors are retroviral vectors that are able to transduce or infect non-dividing cells and typically produce high viral titers. Selection of a retroviral gene transfer system would therefore depend on the target tissue. Retroviral vectors are comprised of cis-acting long terminal repeats with packaging capacity for up to 6-10 kb of foreign sequence. The minimum cis-acting LTRs are sufficient for replication and packaging of the vectors, which are then used to integrate the therapeutic gene into the target cell to provide permanent transgene expression. Widely used retroviral vectors include those based upon murine leukemia virus (MuLV), gibbon ape leukemia virus (GaLV), Simian Immuno deficiency virus (SIV), human immuno deficiency virus (HIV), and combinations thereof (see, e.g., Buchscher et al., *J. Vivol.* 66:2731-2739 (1992); Johann et al., *J. Vivol.* 66:1635-1640 (1992); Sommnerfelt et al., Vivol. 176:58-59 (1990); Wilson et al., *J. Vivol.* 63:2374-2378 (1989); Miller et al., *J. Vivol.* 65:2220-2224 (1991); PCT/US94/05700).

In applications where transient expression is preferred, adenoviral based systems may be used. Adenoviral based vectors are capable of very high transduction efficiency in many cell types and do not require cell division. With such vectors, high titer and levels of expression have been obtained. This vector can be produced in large quantities in a relatively simple system. Adeno-associated virus ("AAV") vectors may also be used to transduce cells with target nucleic acids, e.g., in the in vitro production of nucleic acids and peptides, and for in vivo and ex vivo gene therapy procedures (see, e.g., West et al., *Virology* 160:38-47 (1987); U.S. Pat. No. 4,797,368; WO 93/24641; Katin, *Human Gene Therapy* 5:793-801 (1994); Muzyczka, *J. Clin. Invest.* 94:1351 (1994). Construction of recombinant AAV vectors are described in a number of publications, including U.S. Pat. No. 5,173,414; Tratschin et al., *Mol. Cell. Biol.* 5:3251-3260 (1985); Tratschin, et al., *Mol. Cell. Biol.* 4:2072-2081 (1984); Hermonat & Muzyczka, *PNAS* 81:6466-6470 (1984); and Samulski et al., *J. Vivol.* 63:03822-3828 (1989). Packaging cells are typically used to form virus particles that are capable of infecting a host cell. Such cells include 293 cells, which package adenovirus, and ψJ2 cells or PA317 cells, which package retrovirus.

Viral vectors used in gene therapy are usually generated by producing a cell line that packages a nucleic acid vector into a viral particle. The vectors typically contain the minimal viral sequences required for packaging and subsequent integration into a host, other viral sequences being replaced by an expression cassette for the polynucleotide(s) to be expressed. The missing viral functions are typically supplied in trans by the packaging cell line. For example, AAV vectors used in gene therapy typically only possess ITR sequences from the AAV genome which are required for packaging and integration into the host genome. Viral DNA is packaged in a cell line, which contains a helper plasmid encoding the other AAV genes, namely rep and cap, but lacking ITR sequences.

The cell line may also be infected with adenovirus as a helper. The helper virus promotes replication of the AAV vector and expression of AAV genes from the helper plasmid. The helper plasmid is not packaged in significant amounts due to a lack of ITR sequences. Contamination with adenovirus can be reduced by, e.g., heat treatment to which adenovirus is more sensitive than AAV. Additional methods for the delivery of nucleic acids to cells are known to those skilled in the art. See, for example, US20030087817, incorporated herein by reference.

In some embodiments, a host cell is transiently or non-transiently transfected with one or more vectors described herein. In some embodiments, a cell is transfected as it naturally occurs in a subject. In some embodiments, a cell that is transfected is taken from a subject.

In some embodiments, a cell that is transfected is a eukaryotic cell. In some embodiments, the eukaryotic cell is an animal cell (e.g., mammals, insects, fish, birds, and reptiles). In some embodiments, a cell that is transfected is a human cell. In some embodiments, a cell that is transfected is a cell of hematopoietic origin, such as an immune cell (i.e., a cell of the innate or adaptive immune system) including but not limited to a B cell, a T cell, a natural killer (NK) cell, a pluripotent stem cell, an induced pluripotent stem cell, a chimeric antigen receptor T (CAR-T) cell, a monocyte, a macrophage, and a dendritic cell.

In some embodiments, the cell is derived from cells taken from a subject, such as a cell line. In some embodiments, the cell or cell line is prokaryotic. In some embodiments, the cell or cell line is eukaryotic. In further embodiments, the cell or cell line is derived from insect, avian, plant, or fungal species. In some embodiments, the cell or cell line may be mammalian, such as for example human, monkey, mouse, cow, swine, goat, hamster, rat, cat, or dog. A wide variety of cell lines for tissue culture are known in the art. Examples of cell lines include, but are not limited to, C8161, CCRF-CEM, MOLT, mIMCD-3, NHDF, HeLaS3, Huhl, Huh4, Huh7, HUVEC, HASMC, HEKn, HEKa, MiaPaCell, Panel, PC-3, TF1, CTLL-2, CIR, Rath, CVI, RPTE, A10, T24, 182, A375, ARH-77, Calul, SW480, SW620, SKOV3, SK-UT, CaCo2, P388D1, SEM-K2, WEHI-231, HB56, TIB55, lurkat, 145.01, LRMB, Bcl-1, BC-3, IC21, DLD2, Raw264.7, NRK, NRK-52E, MRCS, MEF, Hep G2, HeLa B, HeLa T4. COS, COS-1, COS-6, COS-M6A, BS-C-1 monkey kidney epithelial, BALB/3T3 mouse embryo fibroblast, 3T3 Swiss, 3T3-Ll, 132-d5 human fetal fibroblasts; 10.1 mouse fibroblasts, 293-T, 3T3, 721, 9L, A2780, A2780ADR, A2780cis, A172, A20, A253, A431, A-549, ALC, B16, B35, BCP-I cells, BEAS-2B, bEnd.3, BHK-21, BR 293, BxPC3, C3H-10T1/2, C6/36, Cal-27, CHO, CHO-7, CHO—IR, CHO-K1, CHO-K2, CHO-T, CHO Dhfr-/-, COR-L23, COR-L23/CPR, COR-L235010, CORL23/R23, COS-7, COV-434, CML Tl, CMT, CT26, D17, DH82, DU145, DuCaP, EL4, EM2, EM3, EMT6/AR1, EMT6/AR10.0, FM3, H1299, H69, HB54, HB55, HCA2, HEK-293, HeLa, Hepalclc7, HL-60, HMEC, HT-29, lurkat, lY cells, K562 cells, Ku812, KCL22, KG1, KYO1, LNCap, Ma-Mel 1-48, MC-38, MCF-7, MCF-10A, MDA-MB-231, MDA-MB-468, MDA-MB-435, MDCKII, MDCKII, MOR/0.2R, MONO-MAC 6, MTD-1A, MyEnd, NCI-H69/CPR, NCI-H69/LX10, NCI-H69/LX20, NCI-H69/LX4, NIH-3T3, NALM-1, NW-145, OPCN/OPCT cell lines, Peer, PNT-1A/PNT 2, RenCa, RIN-5F, RMA/RMAS, Saos-2 cells, Sf-9, SkBr3, T2, T-47D, T84, THP1 cell line, U373, U87, U937, VCaP, Vero cells, WM39, WT-49, X63, YAC-1, YAR, and transgenic varieties thereof. Cell lines are available from a variety of sources known to those with skill in the art (see, e.g., the American Type Culture Collection (ATCC) (Manassas, Va.)).

In some embodiments, a cell transfected with one or more vectors described herein is used to establish a new cell line comprising one or more vector-derived sequences. In some embodiments, a cell transiently transfected with a fusion protein of the invention and optionally a gRNA, or with a ribonucleoprotein complex of the invention, and modified through the activity of a fusion protein or ribonucleoprotein complex, is used to establish a new cell line comprising cells containing the modification but lacking any other exogenous sequence. In some embodiments, cells transiently or non-transiently transfected with one or more vectors described herein, or cell lines derived from such cells are used in assessing one or more test compounds.

In some embodiments, one or more vectors described herein are used to produce a non-human transgenic animal or transgenic plant. In some embodiments, the transgenic animal is an insect. In further embodiments, the insect is an insect pest, such as a mosquito or tick. In some embodiments, the insect is a plant pest, such as a corn rootworm or a fall armyworm. In some embodiments, the transgenic animal is a bird, such as a chicken, turkey, goose, or duck. In some embodiments, the transgenic animal is a mammal, such as a human, mouse, rat, hamster, monkey, ape, rabbit, swine, cow, horse, goat, sheep, cat, or dog.

VI. Variants and Fragments of Polypeptides and Polynucleotides

The present disclosure provides novel adenine deaminases which are active on DNA molecules, the amino acid sequence of which are set forth as SEQ ID NO: 1-10 and 399-441, active variants or fragments thereof, and polynucleotides encoding the same.

While the activity of a variant or fragment may be altered compared to the polynucleotide or polypeptide of interest, the variant and fragment should retain the functionality of the polynucleotide or polypeptide of interest. For example, a variant or fragment may have increased activity, decreased activity, different spectrum of activity or any other alteration in activity when compared to the polynucleotide or polypeptide of interest.

Fragments and variants of deaminases of the invention which have adenine deaminase activity will retain said activity if they are part of a fusion protein further comprising a DNA-binding polypeptide or a fragment thereof.

The term "fragment" refers to a portion of a polynucleotide or polypeptide sequence of the invention. "Fragments" or "biologically active portions" include polynucleotides comprising a sufficient number of contiguous nucleotides to retain the biological activity (i.e., deaminase activity on nucleic acids). "Fragments" or "biologically active portions" include polypeptides comprising a sufficient number of contiguous amino acid residues to retain the biological activity. Fragments of the deaminases disclosed herein include those that are shorter than the full-length sequences due to the use of an alternate downstream start site. In some embodiments, a biologically active portion of a deaminase is a polypeptide that comprises, for example, 10, 20, 30, 40, 50, 60, 70, 80, 90, 100, 110, 120, 130, 140, 150, 160, or more contiguous amino acid residues of any of SEQ ID NOs: 1-10 and 399-441, or a variant thereof. Such biologically active portions can be prepared by recombinant techniques and evaluated for activity.

In general, "variants" is intended to mean substantially similar sequences. For polynucleotides, a variant comprises a deletion and/or addition of one or more nucleotides at one or more internal sites within the native polynucleotide and/or a substitution of one or more nucleotides at one or more sites in the native polynucleotide. As used herein, a "native" or "wild type" polynucleotide or polypeptide comprises a naturally occurring nucleotide sequence or amino acid sequence, respectively. For polynucleotides, conservative variants include those sequences that, because of the degeneracy of the genetic code, encode the native amino acid sequence of the gene of interest. Naturally occurring allelic variants such as these can be identified with the use of well-known molecular biology techniques, as, for example, with polymerase chain reaction (PCR) and hybridization techniques as outlined below. Variant polynucleotides also include synthetically derived polynucleotides, such as those generated, for example, by using site-directed mutagenesis but which still encode the polypeptide or the polynucleotide of interest. Generally, variants of a particular polynucleotide disclosed herein will have at least 40%, at least 45%, at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or more sequence identity to that particular polynucleotide as determined by sequence alignment programs and parameters described elsewhere herein.

Variants of a particular polynucleotide disclosed herein (i.e., the reference polynucleotide) can also be evaluated by comparison of the percent sequence identity between the polypeptide encoded by a variant polynucleotide and the polypeptide encoded by the reference polynucleotide. Percent sequence identity between any two polypeptides can be calculated using sequence alignment programs and parameters described elsewhere herein. Where any given pair of polynucleotides disclosed herein is evaluated by comparison of the percent sequence identity shared by the two polypeptides they encode, the percent sequence identity between the two encoded polypeptides is at least 40%, at least 45%, at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or more sequence identity.

In particular embodiments, the presently disclosed polynucleotides encode an adenine deaminase comprising an amino acid sequence having at least 40%, at least 45%, at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or greater identity to an amino acid sequence of any of SEQ ID NOs: 1-10 and 399-441.

A biologically active variant of an adenine deaminase of the invention may differ by as few as 1-15 amino acid residues, as few as 1-10, such as 6-10, as few as 5, as few as 4, as few as 3, as few as 2, or as few as 1 amino acid residue. In specific embodiments, the polypeptides comprise an N-terminal or a C-terminal truncation, which can comprise at least a deletion of 5, 10, 15, 20, 25, 30, 35, 40, 45, 50, 55, 60 amino acids or more from either the N or C terminus of the polypeptide. In some embodiments, the polypeptides comprise an internal deletion which can comprise at least a deletion of 1, 2, 3, 4, 5, 6, 7, 8, 9, 10, 11, 12, 13, 14, 15, 16, 17, 18, 19, 20, 25, 30, 35, 40, 45, 50, 55, 60 amino acids or more.

It is recognized that modifications may be made to the deaminases provided herein creating variant proteins and polynucleotides. Changes designed by man may be introduced through the application of site-directed mutagenesis techniques. In some embodiments, native, as yet-unknown or as yet unidentified polynucleotides and/or polypeptides structurally and/or functionally-related to the sequences disclosed herein may also be identified that fall within the scope of the present invention. Conservative amino acid substitutions may be made in nonconserved regions that do not alter the function of the polypeptide as an adenine deaminase. In some embodiments, modifications are made that improve the adenine deaminase activity of the deaminase.

Variant polynucleotides and proteins also encompass sequences and proteins derived from a mutagenic and recombinogenic procedure such as DNA shuffling. With such a procedure, one or more different deaminases disclosed herein (e.g., SEQ ID NO: 1-10 and 399-441) is manipulated to create a new adenine deaminase possessing the desired properties. In this manner, libraries of recombinant polynucleotides are generated from a population of related sequence polynucleotides comprising sequence regions that have substantial sequence identity and can be homologously recombined in vitro or in vivo. For example, using this approach, sequence motifs encoding a domain of interest may be shuffled between the deaminase sequences provided herein and other subsequently identified deaminase genes to obtain a new gene coding for a protein with an improved property of interest, such as an increased $K_m$ in the case of an enzyme. Strategies for such DNA shuffling are known in the art. See, for example, Stemmer (1994) *Proc. Natl. Acad. Sci. USA* 91:10747-10751; Stemmer (1994) *Nature* 370:389-391; Crameri et al. (1997) *Nature Biotech.* 15:436-438; Moore et al. (1997) *J Mol. Biol.* 272:336-347; Zhang et al. (1997) *Proc. Natl. Acad. Sci. USA* 94:4504-4509; Crameri et al. (1998) *Nature* 391:288-291; and U.S. Pat. Nos. 5,605,793 and 5,837,458. A "shuffled" nucleic acid is a nucleic acid produced by a shuffling procedure such as any shuffling procedure set forth herein. Shuffled nucleic acids are produced by recombining (physically or virtually) two or more nucleic acids (or character strings), for example in an artificial, and optionally recursive, fashion. Generally, one or more screening steps are used in shuffling processes to identify nucleic acids of interest; this screening step can be performed before or after any recombination step. In some (but not all) shuffling embodiments, it is desirable to perform multiple rounds of recombination prior to selection to increase the diversity of the pool to be screened. The overall process of recombination and selection are optionally repeated recursively. Depending on context, shuffling can refer to an overall process of recombination and selection, or, alternately, can simply refer to the recombinational portions of the overall process.

As used herein, "sequence identity" or "identity" in the context of two polynucleotides or polypeptide sequences makes reference to the residues in the two sequences that are the same when aligned for maximum correspondence over a specified comparison window. When percentage of sequence identity is used in reference to proteins it is recognized that residue positions which are not identical often differ by conservative amino acid substitutions, where amino acid residues are substituted for other amino acid residues with similar chemical properties (e.g., charge or hydrophobicity) and therefore do not change the functional properties of the molecule. When sequences differ in conservative substitutions, the percent sequence identity may be adjusted upwards to correct for the conservative nature of the substitution. Sequences that differ by such conservative substitutions are said to have "sequence similarity" or "similarity". Means for making this adjustment are well known to those of skill in the art. Typically, this involves scoring a conservative substitution as a partial rather than a full mismatch, thereby increasing the percentage sequence identity. Thus, for example, where an identical amino acid is given a score of 1 and a non-conservative substitution is given a score of zero, a conservative substitution is given a score between zero and 1. The scoring of conservative substitutions is calculated, e.g., as implemented in the program PC/GENE (Intelligenetics, Mountain View, California).

As used herein, "percentage of sequence identity" means the value determined by comparing two optimally aligned sequences over a comparison window, wherein the portion of the polynucleotide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison, and multiplying the result by 100 to yield the percentage of sequence identity.

Unless otherwise stated, sequence identity/similarity values provided herein refer to the value obtained using GAP Version 10 using the following parameters: % identity and % similarity for a nucleotide sequence using GAP Weight of 50 and Length Weight of 3, and the nwsgapdna.cmp scoring matrix; % identity and % similarity for an amino acid sequence using GAP Weight of 8 and Length Weight of 2, and the BLOSUM62 scoring matrix; or any equivalent program thereof. By "equivalent program" is intended any sequence comparison program that, for any two sequences in question, generates an alignment having identical nucleotide or amino acid residue matches and an identical percent sequence identity when compared to the corresponding alignment generated by GAP Version 10.

Two sequences are "optimally aligned" when they are aligned for similarity scoring using a defined amino acid substitution matrix (e.g., BLOSUM62), gap existence penalty and gap extension penalty so as to arrive at the highest score possible for that pair of sequences. Amino acid substitution matrices and their use in quantifying the similarity between two sequences are well-known in the art and described, e.g., in Dayhoff et al. (1978) "A model of evolutionary change in proteins." In "Atlas of Protein Sequence and Structure," Vol. 5, Suppl. 3 (ed. M. O. Dayhoff), pp. 345-352. Natl. Biomed. Res. Found., Washington, D.C. and Henikoff et al. (1992) *Proc. Natl. Acad. Sci. USA* 89:10915-10919. The BLOSUM62 matrix is often used as a default scoring substitution matrix in sequence alignment protocols. The gap existence penalty is imposed for the introduction of a single amino acid gap in one of the aligned sequences, and the gap extension penalty is imposed for each additional empty amino acid position inserted into an already opened gap. The alignment is defined by the amino acids positions of each sequence at which the alignment begins and ends, and optionally by the insertion of a gap or multiple gaps in one or both sequences, so as to arrive at the highest possible score. While optimal alignment and scoring can be accomplished manually, the process is facilitated by the use of a computer-implemented alignment algorithm, e.g., gapped BLAST 2.0, described in Altschul et al. (1997) *Nucleic Acids Res.* 25:3389-3402, and made available to the public at the National Center for Biotechnology Information Website (World Wide Web at ncbi.nlm.nih.gov). Optimal alignments, including multiple alignments, can be prepared using, e.g., PSI-BLAST, available through World Wide Web at ncbi.nlm.nih.gov and described by Altschul et al. (1997) *Nucleic Acids Res.* 25:3389-3402.

With respect to an amino acid sequence that is optimally aligned with a reference sequence, an amino acid residue "corresponds to" the position in the reference sequence with which the residue is paired in the alignment. The "position" is denoted by a number that sequentially identifies each amino acid in the reference sequence based on its position relative to the N-terminus. Owing to deletions, insertion, truncations, fusions, etc., that must be taken into account when determining an optimal alignment, in general the amino acid residue number in a test sequence as determined by simply counting from the N-terminal will not necessarily be the same as the number of its corresponding position in the reference sequence. For example, in a case where there is a deletion in an aligned test sequence, there will be no amino acid that corresponds to a position in the reference sequence at the site of deletion. Where there is an insertion in an aligned reference sequence, that insertion will not correspond to any amino acid position in the reference sequence. In the case of truncations or fusions there can be stretches of amino acids in either the reference or aligned sequence that do not correspond to any amino acid in the corresponding sequence.

VII. Antibodies

Antibodies to the deaminases, fusion proteins, or ribonucleoproteins comprising the deaminases of the present invention, including those having the amino acid sequence set forth as any one of SEQ ID NOs: 1-10 and 399-441 or active variants or fragments thereof, are also encompassed. Methods for producing antibodies are well known in the art (see, for example, Harlow and Lane (1988) Antibodies: A Laboratory Manual, Cold Spring Harbor Laboratory, Cold Spring Harbor, N.Y.; and U.S. Pat. No. 4,196,265). These antibodies can be used in kits for the detection and isolation of deaminases or fusion proteins or ribonucleoproteins comprising deaminases described herein. Thus, this disclosure provides kits comprising antibodies that specifically bind to the polypeptides or ribonucleoproteins described herein, including, for example, polypeptides comprising a sequence of at least 85% identity to any of SEQ ID NOs: 1-10 and 399-441.

VIII. Systems and Ribonucleoprotein Complexes for Binding and/or Modifying a Target Sequence of Interest and Methods of Making the Same The present disclosure provides a system which targets to a nucleic acid sequence and modifies a target nucleic acid sequence. In some embodiments, an RNA-guided, DNA-binding polypeptide, such as an RGN, and the gRNA are responsible for targeting the ribonucleoprotein complex to a nucleic acid sequence of interest; the deaminase polypeptide fused to the RGDBP is responsible for modifying the targeted nucleic acid sequence from A>N. In some embodiments, the deaminase converts A>G. The guide RNA hybridizes to the target sequence of interest and also forms a complex with the RNA-guided, DNA-binding polypeptide, thereby directing the RNA-guided, DNA-binding polypeptide to bind to the target sequence. The RNA-guided, DNA-binding polypeptide is one domain of a fusion protein; the second domain is a deaminase described herein. In some embodiments, the RNA-guided, DNA-binding polypeptide is an RGN, such as a Cas9. Other examples of RNA-guided, DNA-binding polypeptides include RGNs such as those described in International Patent Application Publication Nos. WO 2019/236566 and WO 2020/139783. In some embodiments, the RNA-guided, DNA-binding polypeptide is a Type II CRISPR-Cas polypeptide, or an active variant or fragment thereof. In some embodiments, the RNA-guided, DNA-binding polypeptide is a Type V CRISPR-Cas polypeptide, or an active variant or fragment thereof. In some embodiments, the RNA-guided, DNA-binding polypeptide is a Type VI CRISPR-Cas polypeptide. In some embodiments, the DNA-binding domain of the fusion protein does not require an RNA guide, such as a zinc finger nuclease, TALEN, or meganuclease polypeptide. In some embodiments, the nuclease activity of a DNA-binding domain has been partially or completely inactivated. In further embodiments, the RNA-guided, DNA-binding polypeptide comprises an amino acid sequence of an RGN, such as for example APG07433.1 (SEQ ID NO: 41), or an active variant or fragment thereof such as nickase nAPG07433.1 (SEQ ID NO: 42) or other nickase RGN variants described in the Examples (SEQ ID NOs: 52-59, 61, 397, and 398).

In some embodiments, the system for binding and modifying a target sequence of interest provided herein is a ribonucleoprotein complex, which is at least one molecule of an RNA bound to at least one protein. The ribonucleoprotein complexes provided herein comprise at least one guide RNA as the RNA component and a fusion protein comprising a deaminase of the invention and an RNA-guided, DNA-binding polypeptide as the protein component. In some embodiments, the ribonucleoprotein complex is purified from a cell or organism that has been transformed with polynucleotides that encode the fusion protein and a guide RNA and cultured under conditions to allow for the expression of the fusion protein and guide RNA.

In various embodiments, ribonucleoprotein complexes comprising any of the fusion proteins described herein and a guide RNA bound to the DNA-binding polypeptide of the fusion protein, are provided. For example, provided herein is a ribonucleoprotein complex comprising a fusion protein with a deaminase comprising an amino acid sequence having at least 80% sequence identity to SEQ ID NO: 407. In another instance, a ribonucleoprotein complex comprising a fusion protein with a deaminase comprising an amino acid sequence having at least 80% sequence identity to SEQ ID NO: 399, is provided. In yet another example, a ribonucleoprotein complex comprising a fusion protein with a deaminase comprising an amino acid sequence having at least 80% sequence identity to SEQ ID NO: 405, is provided. In some of those embodiments of the ribonucleoprotein complexes described above, the fusion protein comprises an RGN selected from a CasX, a CasY, a C2c1, a C2c2, a C2c3, a GeoCas9, aSpCas9, a SaCas9, a Nme2Cas9, a CjCas9, a Cas12a (formerly known as Cpf1), a Cas12b, a Cas12g, a Cas12h, a Cas12i, aLbCas12a, a AsCas12a, a CasMINI, a Cas13b, a Cas13c, a Cas13d, a Cas14, a Csn2, an xCas9, an SpCas9-NG, an LbCas12a, an AsCas12a, a Cas9-KKH, a circularly permuted Cas9, an Argonaute (Ago), a SmacCas9, a Spy-macCas9 domain, or an RGN with an amino acid sequence set forth in any one of SEQ ID NOs: 41, 60, 366, or 368. In some embodiments, the ribonucleoprotein complex comprises a nickase having an amino acid sequence with at least 95% sequence identity to any one of SEQ ID NOs: 42, 52-59, 61, 397, and 398, fused to a deaminase comprising an amino acid sequence having at least 80% sequence identity to SEQ ID NO: 407. In some embodiments, the ribonucleoprotein complex comprises a nickase having an amino acid sequence with at least 95% sequence identity to any one of SEQ ID NOs: 42, 52-59, 61, 397, and 398, fused to a deaminase comprising an amino acid sequence having at least 80% sequence identity to SEQ ID NO: 399. In some embodiments, the ribonucleoprotein complex comprises a nickase having an amino acid sequence with at least 95% sequence identity to any one of SEQ ID NOs: 42, 52-59, 61, 397, and 398, fused to a deaminase comprising an amino acid sequence having at least 80% sequence identity to SEQ ID NO: 405. In some embodiments, the ribonucleoprotein complex comprises a Cas9 nickase fused to a deaminase comprising an amino acid sequence having at least 80% sequence identity to SEQ ID NO: 407. In some embodiments, the ribonucleoprotein complex comprises a Cas9 nickase fused to a deaminase comprising an amino acid sequence having at least 80% sequence identity to SEQ ID NO: 399. In some embodiments, the ribonucleoprotein complex comprises a Cas9 nickase fused to a deaminase comprising an amino acid sequence having at least 80% sequence identity to SEQ ID NO: 405. The Cas9 nickase, can be any Cas9 nickase disclosed in PCT Patent Publication No. WO2020181195, the entire contents of which is incorporated herein by reference herein. In various embodiments described herein, the ribonucleoprotein complex may also contain the gRNAs described herein.

Methods are provided for making a deaminase, a fusion protein, or a fusion protein ribonucleoprotein complex. Such methods comprise culturing a cell comprising a nucleotide sequence encoding a deaminase, a fusion protein, and in some embodiments a nucleotide sequence encoding a guide RNA, under conditions in which the deaminase or fusion protein (and in some embodiments, the guide RNA) is expressed. The deaminase, fusion protein, or fusion ribonucleoprotein can then be purified from a lysate of the cultured cells.

Methods for purifying a deaminase, fusion protein, or fusion ribonucleoprotein complex from a lysate of a biological sample are known in the art (e.g., size exclusion and/or affinity chromatography, 2D-PAGE, HPLC, reversed-phase chromatography, immunoprecipitation). In particular methods, the deaminase or fusion protein is recombinantly produced and comprises a purification tag to aid in its purification, including but not limited to, glutathione-S-transferase (GST), chitin binding protein (CBP), maltose binding protein, thioredoxin (TRX), poly(NANP), tandem affinity purification (TAP) tag, myc, AcV5, AU1, AU5, E, ECS, E2, FLAG, HA, nus, Softag 1, Softag 3, Strep, SBP, Glu-Glu, HSV, KT3, S, 51, T7, V5, VSV-G, 6×His, biotin carboxyl carrier protein (BCCP), and calmodulin. Generally, the tagged deaminase, fusion protein, or fusion ribonucleoprotein complex is purified using immunoprecipitation or other similar methods known in the art.

An "isolated" or "purified" polypeptide, or biologically active portion thereof, is substantially or essentially free from components that normally accompany or interact with the polypeptide as found in its naturally occurring environment. Thus, an isolated or purified polypeptide is substantially free of other cellular material or culture medium when produced by recombinant techniques, or substantially free of chemical precursors or other chemicals when chemically synthesized. A protein that is substantially free of cellular material includes preparations of protein having less than 30%, less than 20%, less than 10%, less than 5%, or less than 1% (by dry weight) of contaminating protein. When the protein of the invention or biologically active portion thereof is recombinantly produced, optimally culture medium represents less than 30%, less than 20%, less than 10%, less than 5%, or less than 1% (by dry weight) of chemical precursors or non-protein-of-interest chemicals.

Particular methods provided herein for binding and/or cleaving a target sequence of interest involve the use of a ribonucleoprotein complex. In some embodiments, the ribonucleoprotein complex is assembled in vitro. In vitro assembly of a ribonucleoprotein complex can be performed using any method known in the art in which an RGDBP polypeptide or a fusion protein comprising the same is contacted with a guide RNA under conditions to allow for binding of the RGDBP polypeptide or fusion protein comprising the same to the guide RNA. As used herein, "contact", "contacting", "contacted," refer to placing the components of a desired reaction together under conditions suitable for carrying out the desired reaction. In some embodiments of the described methods for modifying a target DNA molecule, the step of contacting is performed in vitro. In some embodiments, the step of contacting is performed in vivo. In some embodiments, the step of contacting is performed in a subject (e.g., a human subject or a non-human animal subject). In some embodiments, the step of contacting is performed in a cell, such as a human or non-human animal cell. The RGDBP polypeptide or fusion protein comprising the same can be purified from a biological sample, cell lysate, or culture medium, produced via in vitro translation, or chemically synthesized. The guide RNA can be purified from a biological sample, cell lysate, or culture medium, transcribed in vitro, or chemically synthesized. The RGDBP polypeptide or fusion protein comprising the same and guide RNA can be brought into contact in solution (e.g., buffered saline solution) to allow for in vitro assembly of the ribonucleoprotein complex.

IX. Methods of Modifying a Target Sequence

The present disclosure provides methods for modifying a target nucleic acid molecule (e.g., target DNA molecule) of interest. The methods include delivering a fusion protein comprising a DNA-binding polypeptide and at least one deaminase of the invention or a polynucleotide encoding the same to a target sequence or a cell, organelle, or embryo comprising a target sequence. In certain embodiments, the methods include delivering a system comprising at least one guide RNA or a polynucleotide encoding the same, and at least one fusion protein comprising at least one deaminase of the invention and an RNA-guided, DNA-binding polypeptide or a polynucleotide encoding the same to the target sequence or a cell, organelle, or embryo comprising the target sequence. In some embodiments, the fusion protein comprises any one of the amino acid sequences of SEQ ID NOs: 1-10 and 399-441, or an active variant or fragment thereof.

In some embodiments, the methods comprise contacting a DNA molecule with (a) a fusion protein comprising a deaminase and an RNA-guided, DNA-binding polypeptide, such as for example a nuclease-inactive or a nickase Cas9 domain; and (b) a gRNA targeting the fusion protein of (a) to a target nucleotide sequence of the DNA molecule; wherein the DNA molecule is contacted with the fusion protein and the gRNA in an amount effective and under conditions suitable for the deamination of a nucleobase. In some embodiments, the target DNA molecule comprises a sequence associated with a disease or disorder, and wherein the deamination of the nucleobase results in a sequence that is not associated with a disease or disorder. In some embodiments, the disease or disorder affects animals. In further embodiments, the disease or disorder affects mammals, such as humans, cows, horses, dogs, cats, goats, sheep, swine, monkeys, rats, mice, or hamsters. In some embodiments, the target DNA sequence resides in an allele of a crop plant, wherein the particular allele of the trait of interest results in a plant of lesser agronomic value. The deamination of the nucleobase results in an allele that improves the trait and increases the agronomic value of the plant.

In those embodiments wherein the method comprises delivering a polynucleotide encoding a guide RNA and/or a fusion protein, the cell or embryo can then be cultured under conditions in which the guide RNA and/or fusion protein are expressed. In various embodiments, the method comprises contacting a target sequence with a ribonucleoprotein complex comprising a gRNA and a fusion protein (which comprises a deaminase of the invention and an RNA-guided DNA-binding polypeptide). In certain embodiments, the method comprises introducing into a cell, organelle, or embryo comprising a target sequence a ribonucleoprotein complex of the invention. The ribonucleoprotein complex of the invention can be one that has been purified from a biological sample, recombinantly produced and subsequently purified, or in vitro-assembled as described herein. In those embodiments wherein the ribonucleoprotein complex that is contacted with the target sequence or a cell organelle, or embryo has been assembled in vitro, the method can further comprise the in vitro assembly of the complex prior to contact with the target sequence, cell, organelle, or embryo.

A purified or in vitro assembled ribonucleoprotein complex of the invention can be introduced into a cell, organelle, or embryo using any method known in the art, including, but not limited to electroporation. In some embodiments, a fusion protein comprising a deaminase of the invention and an RNA-guided, DNA-binding polypeptide, and a polynucleotide encoding or comprising the guide RNA is introduced into a cell, organelle, or embryo using any method known in the art (e.g., electroporation).

Upon delivery to or contact with the target sequence or cell, organelle, or embryo comprising the target sequence, the guide RNA directs the fusion protein to bind to the target sequence in a sequence-specific manner. The target sequence can subsequently be modified via the deaminase domain of the fusion protein. In some embodiments, the binding of this fusion protein to a target sequence results in modification of a nucleotide adjacent to the target sequence. The nucleobase adjacent to the target sequence that is modified by the deaminase may be 1, 2, 3, 4, 5, 6, 7, 8, 9, 10, 11, 12, 13, 14, 15, 16, 17, 18, 19, 20, 25, 30, 35, 40, 45, 50, 55, 60, 65, 70, 75, 80, 85, 90, 95, or 100 base pairs from the 5' or 3' end of the target sequence. A fusion protein comprising a deaminase of the invention and an RNA-guided, DNA-binding polypeptide can introduce targeted A>N, and preferably targeted A>G, mutations in the targeted DNA molecule.

In some embodiments of the described methods for modifying a target DNA molecule, the step of contacting is performed in vitro. In particular embodiments, the step of contacting is performed in vivo. In some embodiments, the step of contacting is performed in a subject (e.g., a human subject or a non-human animal subject). In some embodiments, the step of contacting is performed in a cell, such as a human or non-human animal cell.

Methods to measure binding of the fusion protein to a target sequence are known in the art and include chromatin immunoprecipitation assays, gel mobility shift assays, DNA pull-down assays, reporter assays, microplate capture and detection assays. Likewise, methods to measure cleavage or modification of a target sequence are known in the art and include in vitro or in vivo cleavage assays wherein cleavage is confirmed using PCR, sequencing, or gel electrophoresis, with or without the attachment of an appropriate label (e.g., radioisotope, fluorescent substance) to the target sequence to facilitate detection of degradation products. In some embodiments, the nicking triggered exponential amplification reaction (NTEXPAR) assay is used (see, e.g., Zhang et al. (2016) *Chem. Sci.* 7:4951-4957). In vivo cleavage can be evaluated using the Surveyor assay (Guschin et al. (2010) *Methods Mol Biol* 649:247-256).

In some embodiments, the methods involve the use of an RNA-binding, DNA-guided domain, as part of the fusion protein, complexed with more than one guide RNA. The more than one guide RNA can target different regions of a single gene or can target multiple genes. This multiple targeting enables the deaminase domain of the fusion protein to modify nucleic acids, thereby introducing multiple mutations in the target nucleic acid molecule (e.g., genome) of interest.

In those embodiments wherein the method involves the use of an RNA-guided nuclease (RGN), such as a nickase RGN (i.e., is only able to cleave a single strand of a double-stranded polynucleotide, for example nAPG07433.1 (SEQ ID NO: 42 or SEQ ID NOs: 50-57), the method can comprise introducing two different RGNs or RGN variants that target identical or overlapping target sequences and cleave different strands of the polynucleotide. For example, an RGN nickase that only cleaves the positive (+) strand of a double-stranded polynucleotide can be introduced along with a second RGN nickase that only cleaves the negative (−) strand of a double-stranded polynucleotide. In some embodiments, two different fusion proteins are provided, where each fusion protein comprises a different RGN with a different PAM recognition sequence, so that a greater diversity of nucleotide sequences may be targeted for mutation.

One of ordinary skill in the art will appreciate that any of the presently disclosed methods can be used to target a single target sequence or multiple target sequences. Thus, methods comprise the use of a fusion protein comprising a single RNA-guided, DNA-binding polypeptide in combination with multiple, distinct guide RNAs, which can target multiple, distinct sequences within a single gene and/or multiple genes. The deaminase domain of the fusion protein would then introduce mutations at each of the targeted sequences. Also encompassed herein are methods wherein multiple, distinct guide RNAs are introduced in combination with multiple, distinct RNA-guided, DNA binding polypeptides. Such RNA-guided, DNA-binding polypeptides may be multiple RGN or RGN variants. These guide RNAs and guide RNA/fusion protein systems can target multiple, distinct sequences within a single gene and/or multiple genes.

In some embodiments, a fusion protein comprising an RNA-guided, DNA-binding polypeptide and a deaminase polypeptide of the invention may be used for generating mutations in a targeted gene or targeted region of a gene of interest. In some embodiments, a fusion protein of the invention may be used for saturation mutagenesis of a targeted gene or region of a targeted gene of interest followed by high-throughput forward genetic screening to identify novel mutations and/or phenotypes. In some embodiments, a fusion protein described herein may be used for generating mutations in a targeted genomic location, which may or may not comprise coding DNA sequence. Libraries of cell lines generated by the targeted mutagenesis described above may also be useful for study of gene function or gene expression.

X. Target Polynucleotides

In one aspect, the invention provides for methods of modifying a target polynucleotide in a eukaryotic cell, which may be in vivo, ex vivo or in vitro. In some embodiments, the method comprises sampling a cell or population of cells from a human or non-human animal or plant (including microalgae) and modifying the cell or cells. Culturing may occur at any stage ex vivo. The cell or cells may even be re-introduced into the human, non-human animal or plant (including micro-algae).

Using natural variability, plant breeders combine most useful genes for desirable qualities, such as yield, quality, uniformity, hardiness, and resistance against pests. These desirable qualities also include growth, day length preferences, temperature requirements, initiation date of floral or reproductive development, fatty acid content, insect resistance, disease resistance, nematode resistance, fungal resistance, herbicide resistance, tolerance to various environmental factors including drought, heat, wet, cold, wind, and adverse soil conditions including high salinity. The sources of these useful genes include native or foreign varieties, heirloom varieties, wild plant relatives, and induced mutations, e.g., treating plant material with mutagenic agents. Using the present invention, plant breeders are provided with a new tool to induce mutations. Accordingly, one skilled in the art can employ the present invention to induce the rise of useful genes, with more precision than previous mutagenic agents and hence accelerate and improve plant breeding programs.

The target polynucleotide of a deaminase or a fusion protein of the invention can be any polynucleotide endogenous or exogenous to the eukaryotic cell. For example, the target polynucleotide can be a polynucleotide residing in the nucleus of the eukaryotic cell. In some embodiments, the target polynucleotide is a sequence coding a gene product (e.g., a protein) or a non-coding sequence (e.g., a regulatory polynucleotide or a junk DNA). In some embodiments, the target sequence for a fusion protein of the invention is associated with a PAM (protospacer adjacent motif); that is, a short sequence recognized by the RNA-guided DNA-binding polypeptide. The precise sequence and length requirements for the PAM differ depending on the RNA-guided DNA-binding polypeptide used, but PAMs are typically 2-5 base pair sequences adjacent the protospacer (that is, the target sequence).

The target polynucleotide of a fusion protein of the invention may include a number of disease-associated genes and polynucleotides as well as signaling biochemical pathway-associated genes and polynucleotides. Examples of target polynucleotides include a sequence associated with a signaling biochemical pathway, e.g., a signaling biochemical pathway-associated gene or polynucleotide. Examples of target polynucleotides include a disease associated gene or polynucleotide. A "disease-associated" gene or polynucleotide refers to any gene or polynucleotide which is yielding transcription or translation products at an abnormal level or in an abnormal form in cells derived from a disease-affected tissues compared with tissues or cells of a non-disease control. It may be a gene that becomes expressed at an abnormally high level; it may be a gene that becomes expressed at an abnormally low level, where the altered expression correlates with the occurrence and/or progression of the disease. A disease-associated gene also refers to a gene possessing mutation(s) or genetic variation that is directly responsible or is in linkage disequilibrium with a gene(s) that is responsible for the etiology of a disease (e.g., a causal mutation). The transcribed or translated products may be known or unknown, and further may be at a normal or abnormal level.

Non-limiting examples of disease-associated genes that can be targeted using the presently disclosed methods and compositions are provided in Table 34. In some embodiments, the disease-associated gene that is targeted are those disclosed in Table 34 having a G>A mutation. Additional examples of disease-associated genes and polynucleotides are available from McKusick-Nathans Institute of Genetic Medicine, Johns Hopkins University (Baltimore, Md.) and National Center for Biotechnology Information, National Library of Medicine (Bethesda, Md.), available on the World Wide Web.

In some embodiments, the target polynucleotide comprises a cystic fibrosis transmembrane conductance regulator (5) gene.

As used herein, the term "cystic fibrosis transmembrane conductance regulator" or "CFTR" refers to a cAMP regulated chloride channel located in the apical membrane of epithelial cells that catalyze the passage of small ions through the membrane. A non-limiting example of a CFTR gene is set forth as SEQ ID NO: 51.

As used herein, the term "target" or "targets," in relation to a spacer sequence and a target sequence, refers to the localization of an RNA-guided nuclease to a target sequence based on the ability of a spacer sequence within an associated guide RNA to hybridize sufficiently with a target sequence.

CRISPR RNAs (crRNAs) or nucleic acid molecules encoding the same, wherein the crRNA comprises a spacer sequence that targets a CFTR target sequence are provided. Guide RNAs comprising such crRNAs, one or more nucleic acid molecules encoding a guide RNA comprising such crRNAs, vectors comprising one or more nucleic acid molecules encoding a guide RNA comprising such crRNAs, and systems comprising such crRNAs are also provided. Methods of using such crRNAs or nucleic molecules encoding the same, guide RNAs comprising such crRNAs, one or more nucleic acid molecules encoding a guide RNA comprising such crRNAs, vectors comprising one or more nucleic acid molecules encoding a guide RNA comprising such crRNAs, and systems comprising such crRNAs to bind to, cleave, and/or modulate the target sequence are also provided.

In some embodiments, the CFTR target sequence of a crRNA or a guide RNA has the sequence set forth in any one of SEQ ID NOs: 98-115, 140-151, 186-202, 235-250, 287-304, 345-364, 562, and 563, or the complement thereof. In some embodiments, a single guide RNA (sgRNA) comprising a crRNA having a spacer sequence that targets a CFTR target sequence has at least 40%, 45%, 50%, 55%, 60%, 65%, 70%, 75%, 80%, 85%, 90%, 91%, 92%, 93%, 94%, 95%, 96%, 97%, 98%, 99% or more sequence identity to any one of SEQ ID NOs: 98-115, 140-151, 186-202, 235-250, 287-304, 345-364, and 564.

In some embodiments, the CFTR target sequence of a crRNA or a guide RNA has the sequence set forth in any one of SEQ ID NOs: 62-68, 80-85, 116-119, 128-131, 163, 164, 180, 181, 203-209, 219-225, 256-258, 274-276, 310-313, and 330-333, or the complement thereof, and the associated RGN polypeptide has an amino acid sequence having at least 40%, 45%, 50%, 55%, 60%, 65%, 70%, 75%, 80%, 85%, 90%, 91%, 92%, 93%, 94%, 95%, 96%, 97%, 98%, 99% or more sequence identity to SEQ ID NO: 53. In some embodiments, a sgRNA comprising a crRNA having a spacer sequence that targets a CFTR target sequence has at least 40%, 45%, 50%, 55%, 60%, 65%, 70%, 75%, 80%, 85%, 90%, 91%, 92%, 93%, 94%, 95%, 96%, 97%, 98%, 99% or more sequence identity to any one of SEQ ID NOs: 98-104, 140-143, 197, 198, 235-241, 292-294, and 350-353, and the associated RGN polypeptide has an amino acid sequence having at least 40%, 45%, 50%, 55%, 60%, 65%, 70%, 75%, 80%, 85%, 90%, 91%, 92%, 93%, 94%, 95%, 96%, 97%, 98%, 99% or more sequence identity to SEQ ID NO: 53.

In some embodiments, the CFTR target sequence of a crRNA or a guide RNA has the sequence set forth in any one of SEQ ID NOs: 68-71, 86-89, 120-122, 132-134, 152-156, 169-173, 213-215, 229-231, 251-255, 269-273, 305-309, and 325-329, or the complement thereof and the associated RGN polypeptide has an amino acid sequence having at least 40%, 45%, 50%, 55%, 60%, 65%, 70%, 75%, 80%, 85%, 90%, 91%, 92%, 93%, 94%, 95%, 96%, 97%, 98%, 99% or more sequence identity to SEQ ID NO: 55. In some embodiments, a sgRNA comprising a crRNA having a spacer sequence that targets a CFTR target sequence has at least 40%, 45%, 50%, 55%, 60%, 65%, 70%, 75%, 80%, 85%, 90%, 91%, 92%, 93%, 94%, 95%, 96%, 97%, 98%, 99% or more sequence identity to any one of SEQ ID NOs: 104-107, 144-146, 186-190, 245-247, 287-291, and 345-349, and the associated RGN polypeptide has an amino acid sequence having at least 40%, 45%, 50%, 55%, 60%, 65%, 70%, 75%, 80%, 85%, 90%, 91%, 92%, 93%, 94%, 95%, 96%, 97%, 98%, 99% or more sequence identity to SEQ ID NO: 55.

In some embodiments, the CFTR target sequence of a crRNA or a guide RNA has the sequence set forth in any one of SEQ ID NOs: 72, 73, 90, 91, 161, 162, 178, 179, 265, 266, 283, and 284, or the complement thereof and the associated RGN polypeptide has an amino acid sequence having at least 40%, 45%, 50%, 55%, 60%, 65%, 70%, 75%, 80%, 85%, 90%, 91%, 92%, 93%, 94%, 95%, 96%, 97%, 98%, 99% or more sequence identity to SEQ ID NO: 52. In some embodiments, a sgRNA comprising a crRNA having a spacer sequence that targets a CFTR target sequence has at least 40%, 45%, 50%, 55%, 60%, 65%, 70%, 75%, 80%, 85%, 90%, 91%, 92%, 93%, 94%, 95%, 96%, 97%, 98%, 99% or more sequence identity to any one of SEQ ID NOs: 108, 109, 195, 196, 301, and 302, and the associated RGN polypeptide has an amino acid sequence having at least 40%, 45%, 50%, 55%, 60%, 65%, 70%, 75%, 80%, 85%, 90%, 91%, 92%, 93%, 94%, 95%, 96%, 97%, 98%, 99% or more sequence identity to SEQ ID NO: 52.

In some embodiments, the CFTR target sequence of a crRNA or a guide RNA has the sequence set forth in any one of SEQ ID NOs: 74, 75, 92, 93, 123, 124, 135, 136, 167, 184, 216-218, 232-234, 259-261, 277-279, 314-317, and 334-337, or the complement thereof and the associated RGN polypeptide has an amino acid sequence having at least 40%, 45%, 50%, 55%, 60%, 65%, 70%, 75%, 80%, 85%, 90%, 91%, 92%, 93%, 94%, 95%, 96%, 97%, 98%, 99% or more sequence identity to SEQ ID NO: 56. In some embodiments, a sgRNA comprising a crRNA having a spacer sequence that targets a CFTR target sequence has at least 40%, 45%, 50%, 55%, 60%, 65%, 70%, 75%, 80%, 85%, 90%, 91%, 92%, 93%, 94%, 95%, 96%, 97%, 98%, 99% or more sequence identity to any one of SEQ ID NOs: 110, 111, 147, 148, 201, 248-250, 295-297, and 354-357, and the associated RGN polypeptide has an amino acid sequence having at least 40%, 45%, 50%, 55%, 60%, 65%, 70%, 75%, 80%, 85%, 90%, 91%, 92%, 93%, 94%, 95%, 96%, 97%, 98%, 99% or more sequence identity to SEQ ID NO: 56.

In some embodiments, the CFTR target sequence of a crRNA or a guide RNA has the sequence set forth in any one of SEQ ID NOs: 76, 94, 210-212, 226-228, 322, 342, 562, and 563, or the complement thereof and the associated RGN polypeptide has an amino acid sequence having at least 40%, 45%, 50%, 55%, 60%, 65%, 70%, 75%, 80%, 85%, 90%, 91%, 92%, 93%, 94%, 95%, 96%, 97%, 98%, 99% or more sequence identity to SEQ ID NO: 42. In some embodiments, a sgRNA comprising a crRNA having a spacer sequence that targets a CFTR target sequence has at least 40%, 45%, 50%, 55%, 60%, 65%, 70%, 75%, 80%, 85%, 90%, 91%, 92%, 93%, 94%, 95%, 96%, 97%, 98%, 99% or more sequence identity to any one of SEQ ID NOs: 112, 242-244, 362, and 564, and the associated RGN polypeptide has an amino acid sequence having at least 40%, 45%, 50%, 55%, 60%, 65%, 70%, 75%, 80%, 85%, 90%, 91%, 92%, 93%, 94%, 95%, 96%, 97%, 98%, 99% or more sequence identity to SEQ ID NO: 42.

In some embodiments, the CFTR target sequence of a crRNA or a guide RNA has the sequence set forth in any one of SEQ ID NOs: 77, 95, 125, 137, 157-160, 174-177, 323, and 343, or the complement thereof and the associated RGN polypeptide has an amino acid sequence having at least 40%, 45%, 50%, 55%, 60%, 65%, 70%, 75%, 80%, 85%, 90%, 91%, 92%, 93%, 94%, 95%, 96%, 97%, 98%, 99% or more sequence identity to SEQ ID NO: 54. In some embodiments, a sgRNA comprising a crRNA having a spacer sequence that targets a CFTR target sequence has at least 40%, 45%, 50%, 55%, 60%, 65%, 70%, 75%, 80%, 85%, 90%, 91%, 92%, 93%, 94%, 95%, 96%, 97%, 98%, 99% or more sequence identity to any one of SEQ ID NOs: 113, 149, 191-194, and 363, and the associated RGN polypeptide has an amino acid sequence having at least 40%, 45%, 50%, 55%, 60%, 65%, 70%, 75%, 80%, 85%, 90%, 91%, 92%, 93%, 94%, 95%, 96%, 97%, 98%, 99% or more sequence identity to SEQ ID NO: 54.

In some embodiments, the CFTR target sequence of a crRNA or a guide RNA has the sequence set forth in any one of SEQ ID NOs: 78, 96, 126, 138, 168, 185, 267, 285, 318, 319, 338, and 339, or the complement thereof and the associated RGN polypeptide has an amino acid sequence having at least 40%, 45%, 50%, 55%, 60%, 65%, 70%, 75%, 80%, 85%, 90%, 91%, 92%, 93%, 94%, 95%, 96%, 97%, 98%, 99% or more sequence identity to SEQ ID NO: 57. In some embodiments, a sgRNA comprising a crRNA having a spacer sequence that targets a CFTR target sequence has at least 40%, 45%, 50%, 55%, 60%, 65%, 70%, 75%, 80%, 85%, 90%, 91%, 92%, 93%, 94%, 95%, 96%, 97%, 98%, 99% or more sequence identity to any one of SEQ ID NOs: 114, 150, 202, 303, 358, and 359, and the associated RGN polypeptide has an amino acid sequence having at least 40%, 45%, 50%, 55%, 60%, 65%, 70%, 75%, 80%, 85%, 90%, 91%, 92%, 93%, 94%, 95%, 96%, 97%, 98%, 99% or more sequence identity to SEQ ID NO: 57.

In some embodiments, the CFTR target sequence of a crRNA or a guide RNA has the sequence set forth in any one of SEQ ID NOs: 79, 97, 127, 139, 262-264, 280-282, 324, and 344, or the complement thereof and the associated RGN polypeptide has an amino acid sequence having at least 40%, 45%, 50%, 55%, 60%, 65%, 70%, 75%, 80%, 85%, 90%, 91%, 92%, 93%, 94%, 95%, 96%, 97%, 98%, 99% or more sequence identity to SEQ ID NO: 58. In some embodiments, a sgRNA comprising a crRNA having a spacer sequence that targets a CFTR target sequence has at least 40%, 45%, 50%, 55%, 60%, 65%, 70%, 75%, 80%, 85%, 90%, 91%, 92%, 93%, 94%, 95%, 96%, 97%, 98%, 99% or more sequence identity to any one of SEQ ID NOs: 115, 151, 298-300, and 364, and the associated RGN polypeptide has an amino acid sequence having at least 40%, 45%, 50%, 55%, 60%, 65%, 70%, 75%, 80%, 85%, 90%, 91%, 92%, 93%, 94%, 95%, 96%, 97%, 98%, 99% or more sequence identity to SEQ ID NO: 58.

In some embodiments, the CFTR target sequence of a crRNA or a guide RNA has the sequence set forth in any one of SEQ ID NOs: 165, 166, 182, 183, 268, 286, 320, 321, 340, and 341, or the complement thereof and the associated RGN polypeptide has an amino acid sequence having at least 40%, 45%, 50%, 55%, 60%, 65%, 70%, 75%, 80%, 85%, 90%, 91%, 92%, 93%, 94%, 95%, 96%, 97%, 98%, 99% or more sequence identity to SEQ ID NO: 59. In some embodiments, a sgRNA comprising a crRNA having a spacer sequence that targets a CFTR target sequence has at least 40%, 45%, 50%, 55%, 60%, 65%, 70%, 75%, 80%, 85%, 90%, 91%, 92%, 93%, 94%, 95%, 96%, 97%, 98%, 99% or more sequence identity to any one of SEQ ID NOs: 199, 200, 304, 360, and 361, and the associated RGN polypeptide has an amino acid sequence having at least 40%, 45%, 50%, 55%, 60%, 65%, 70%, 75%, 80%, 85%, 90%, 91%, 92%, 93%, 94%, 95%, 96%, 97%, 98%, 99% or more sequence identity to SEQ ID NO: 59.

In some embodiments, the methods comprise contacting a DNA molecule comprising a target DNA sequence with a DNA-binding polypeptide-deaminase fusion protein of the invention, wherein the DNA molecule is contacted with the fusion protein in an amount effective and under conditions suitable for the deamination of a nucleobase. In certain embodiments, the methods comprise contacting a DNA molecule comprising a target DNA sequence with (a) an RGN-deaminase fusion protein of the invention; and (b) a gRNA targeting the fusion protein of (a) to a target nucleotide sequence of the DNA strand; wherein the DNA molecule is contacted with the fusion protein and the gRNA in an amount effective and under conditions suitable for the deamination of a nucleobase. In some embodiments, the target DNA sequence comprises a sequence associated with a disease or disorder, and wherein the deamination of the nucleobase results in a sequence that is not associated with a disease or disorder. In some embodiments, the target DNA sequence resides in an allele of a crop plant, wherein the particular allele of the trait of interest results in a plant of lesser agronomic value. The deamination of the nucleobase results in an allele that improves the trait and increases the agronomic value of the plant.

In some embodiments, the target DNA sequence comprises a G>A point mutation associated with a disease or disorder, and wherein the deamination of the mutant A base results in a sequence that is not associated with a disease or disorder. In some embodiments, the deamination corrects a point mutation in the sequence associated with the disease or disorder. In some embodiments, the sequence associated with the disease or disorder encodes a protein, and the deamination introduces a stop codon into the sequence associated with the disease or disorder, resulting in a truncation of the encoded protein. In some embodiments, the contacting is performed in vivo in a subject susceptible to having, having, or diagnosed with the disease or disorder. In some embodiments, the disease or disorder is a disease associated with a point mutation, or a single-base mutation, in the genome. In some embodiments, the disease is a genetic disease, a cancer, a metabolic disease, or a lysosomal storage disease.

XI. Pharmaceutical Compositions and Methods of Treatment

Methods of treating a disease in a subject in need thereof are provided herein. The methods comprise administering to a subject in need thereof an effective amount of a presently disclosed fusion protein or a polynucleotide encoding the same, a presently disclosed gRNA or a polynucleotide encoding the same, a presently disclosed fusion protein system, a presently disclosed ribonucleoprotein complex, or a cell modified by or comprising any one of these compositions.

In some embodiments, the treatment comprises in vivo gene editing by administering to a subject in need thereof a presently disclosed fusion protein, gRNA, or a presently disclosed fusion protein system or polynucleotide(s) encoding the same. In some embodiments, the treatment comprises ex vivo gene editing wherein cells are genetically modified ex vivo with a presently disclosed fusion protein, gRNA, or a presently disclosed fusion protein system or polynucleotide(s) encoding the same and then the modified cells are administered to a subject. In some embodiments, the genetically modified cells originate from the subject that is then administered the modified cells, and the transplanted cells are referred to herein as autologous. In some embodiments, the genetically modified cells originate from a different subject (i.e., donor) within the same species as the subject that is administered the modified cells (i.e., recipient), and the transplanted cells are referred to herein as allogeneic. In some examples described herein, the cells can be expanded in culture prior to administration to a subject in need thereof.

For example, in some embodiments, a method is provided that comprises administering to a subject having such a disease, e.g., a genetic defect associated with the CFTR gene, an effective amount of ribonucleoprotein complex comprising a fusion protein with a deaminase having an amino acid sequence that is at least 80% identical to sequence set forth in any one of the SEQ ID NOs: 399, and 405-407. In the embodiments described herein, the administration of the ribonucleoprotein complex corrects the point mutation or introduces a deactivating mutation into a disease-associated CFTR gene. Other diseases that can be treated by correcting a point mutation or introducing a deactivating mutation into a disease-associated gene will be known to those of skill in the art, and the disclosure is not limited in this respect.

In some embodiments, the disease to be treated with the presently disclosed compositions is one that can be treated with immunotherapy, such as with a chimeric antigen receptor (CAR) T cell. Such diseases include but are not limited to cancer.

In some embodiments, the deamination of the target nucleobase results in the correction of a genetic defect, e.g., to correct the CFTR gene, or in the correction of a point mutation that leads to a loss of function in a gene product. In some embodiments, the genetic defect is associated with a disease or disorder, e.g., a lysosomal storage disorder or a metabolic disease, such as, for example, type I diabetes. Thus, in some embodiments, the disease to be treated with the presently disclosed compositions is associated with a sequence (i.e., the sequence is causal for the disease or disorder or causal for symptoms associated with the disease or disorder) that is mutated in order to treat the disease or disorder or the reduction of symptoms associated with the disease or disorder.

In some embodiments, the disease to be treated with the presently disclosed compositions is associated with a causal mutation. As used herein, a "causal mutation" refers to a particular nucleotide, nucleotides, or nucleotide sequence in the genome that contributes to the severity or presence of a disease or disorder in a subject. The correction of the causal mutation leads to the improvement of at least one symptom resulting from a disease or disorder. In some embodiments, the correction of the causal mutation leads to the improvement of at least one symptom resulting from a disease or disorder. In some embodiments, the causal mutation is adjacent to a PAM site recognized by the RGDBP (e.g., RGN) fused to a deaminase disclosed herein. The causal mutation can be corrected with a fusion polypeptide comprising a RGDBP (e.g., RGN) and a presently disclosed deaminase. Non-limiting examples of diseases associated with a causal mutation include cystic fibrosis, Hurler syndrome, Friedreich's Ataxia, Huntington's Disease, and sickle cell disease. Additional non-limiting examples of disease-associated genes and mutations are available from McKusick-Nathans Institute of Genetic Medicine, Johns Hopkins University (Baltimore, Md.) and National Center for Biotechnology Information, National Library of Medicine (Bethesda, Md.), available on the World Wide Web.

In some embodiments, the methods provided herein are used to introduce a deactivating point mutation into a gene or allele that encodes a gene product that is associated with a disease or disorder. For example, in some embodiments, methods are provided herein that employ a fusion protein to introduce a deactivating point mutation into an oncogene (e.g., in the treatment of a proliferative disease). A deactivating mutation may, in some embodiments, generate a premature stop codon in a coding sequence, which results in the expression of a truncated gene product, e.g., a truncated protein lacking the function of the full-length protein. In some embodiments, the purpose of the methods provided herein is to restore the function of a dysfunctional gene via genome editing. The fusion proteins provided herein can be validated for gene editing-based human therapeutics in vitro, e.g., by correcting a disease associated mutation in human cell culture. It will be understood by the skilled artisan that the fusion proteins provided herein, e.g., the fusion proteins comprising an RNA-guided, DNA-binding polypeptide and deaminase polypeptide can be used to correct any single point G>A mutation. Deamination of the mutant A to G leads to a correction of the mutation.

As used herein, "treatment" or "treating," or "palliating" or "ameliorating" are used interchangeably. These terms refer to an approach for obtaining beneficial or desired results including but not limited to a therapeutic benefit and/or a prophylactic benefit. By therapeutic benefit is meant any therapeutically relevant improvement in or effect on one or more diseases, conditions, or symptoms under treatment. For prophylactic benefit, the compositions may be administered to a subject at risk of developing a particular disease, condition, or symptom, or to a subject reporting one or more of the physiological symptoms of a disease, even though the disease, condition, or symptom may not have yet been manifested. In some embodiments, treatment may be administered after one or more symptoms have developed and/or after a disease has been diagnosed. In particular embodiments, treatment may be administered in the absence of symptoms, e.g., to prevent or delay onset of a symptom or inhibit onset or progression of a disease. For example, treatment may be administered to a susceptible individual prior to the onset of symptoms (e.g., in light of a history of symptoms and/or in light of genetic or other susceptibility factors). Treatment may also be continued after symptoms have resolved, for example, to prevent or delay their prevention or recurrence.

The term "effective amount" or "therapeutically effective amount" refers to the amount of an agent that is sufficient to effect beneficial or desired results. The therapeutically effective amount may vary depending upon one or more of: the subject and disease condition being treated, the weight and age of the subject, the severity of the disease condition, the manner of administration and the like, which can readily be determined by one of ordinary skill in the art. The specific dose may vary depending on one or more of: the particular agent chosen, the dosing regimen to be followed, whether it is administered in combination with other compounds, timing of administration, and the delivery system in which it is carried.

The term "administering" refers to the placement of an active ingredient into a subject, by a method or route that results in at least partial localization of the introduced active ingredient at a desired site, such as a site of injury or repair, such that a desired effect(s) is produced. In some embodiments, the disclosure provides methods comprising delivering any of the isolated polypeptides, nucleic acid molecules fusion proteins, ribonucleoprotein complexes, vectors, pharmaceutical compositions and/or gRNAs described herein. In some embodiments, the disclosure further provides cells produced by such methods, and organisms (such as animals or plants) comprising or produced from such cells. In some embodiments, a deaminase, fusion protein and/or nucleic acid molecules as described herein in combination with (and optionally complexed with) a guide sequence is delivered to a cell.

In some embodiments, the administering comprises administering by viral delivery. Viral vectors comprising a nucleic acid encoding the fusion proteins, ribonucleoprotein complexes, or vectors disclosed herein may be administered directly to patients (i.e., in vivo) or they may be used to treat cells in vitro, and the modified cells may optionally be administered to patients (i.e., ex vivo). Conventional viral based systems may include, without limitation, retroviral, lentivirus, adenoviral, adeno-associated and herpes simplex virus vectors for gene transfer. Integration in the host genome is possible with the retrovirus, lentivirus, and adeno-associated virus gene transfer methods, often resulting in long term expression of the inserted transgene. Lentiviral vectors are retroviral vectors that are able to transduce or infect non-dividing cells and typically produce high viral titers. In applications where transient expression is preferred, adenoviral based systems may be used. Adenoviral based vectors are capable of very high transduction efficiency in many cell types and do not require cell division.

In some embodiments, the administering comprises administering by electroporation. In some embodiments, the administering comprises administering by nanoparticle delivery. In some embodiments, the administering comprises administering by liposome delivery. Any effective route of administration can be used to administer an effective amount of a pharmaceutical composition described herein.

In some embodiments, the administering comprises administering by other non-viral delivery of nucleic acids. Exemplary non-viral delivery methods, without limitation, include RNP complexes, lipofection, nucleofection, microinjection, biolistics, virosomes, liposomes, immunoliposomes, polycation or lipidmucleic acid conjugates, naked DNA, artificial virions, and agent-enhanced uptake of DNA. Lipofection is described in e.g., U.S. Pat. Nos. 5,049,386, 4,946,787; and 4,897,355) and lipofection reagents are sold commercially (e.g., Transfectam™ and Lipofectin™). Cationic and neutral lipids that are suitable for efficient receptor-recognition lipofection of polynucleotides include those of Feigner, WO1991/17424; WO 1991/16024. Delivery can be to cells (e.g. in vitro or ex vivo administration) or target tissues (e.g. in vivo administration).

As used herein, the term "subject" refers to any individual for whom diagnosis, treatment or therapy is desired. In some embodiments, the subject is an animal. In some embodiments, the subject is a mammal. In some embodiments, the subject is a human being.

The efficacy of a treatment can be determined by the skilled clinician. However, a treatment is considered an "effective treatment," if any one or all of the signs or symptoms of a disease or disorder are altered in a beneficial manner (e.g., decreased by at least 10%), or other clinically accepted symptoms or markers of disease are improved or ameliorated. Efficacy can also be measured by failure of an individual to worsen as assessed by hospitalization or need for medical interventions (e.g., progression of the disease is halted or at least slowed). Methods of measuring these indicators are known to those of skill in the art. Treatment includes: (1) inhibiting the disease, e.g., arresting, or slowing the progression of symptoms; or (2) relieving the disease, e.g., causing regression of symptoms; and (3) preventing or reducing the likelihood of the development of symptoms.

Pharmaceutical compositions comprising the presently disclosed RGN polypeptides or polynucleotides encoding the same, the presently disclosed gRNAs or polynucleotides encoding the same, the presently disclosed deaminases or polynucleotides encoding the same, the presently disclosed fusion proteins, the presently disclosed systems (such as those comprising a fusion protein), the presently disclosed ribonucleoprotein complex or cells comprising any of the RGN polypeptides or RGN-encoding polynucleotides, gRNA or gRNA-encoding polynucleotides, fusion protein-encoding polynucleotides, or the systems, and a pharmaceutically acceptable carrier are provided.

As used herein, a "pharmaceutically acceptable carrier" refers to a material that does not cause significant irritation to an organism and does not abrogate the activity and properties of the active ingredient (e.g., a deaminase or fusion protein or nucleic acid molecule encoding the same). Carriers must be of sufficiently high purity and of sufficiently low toxicity to render them suitable for administration to a subject being treated. The carrier can be inert, or it can possess pharmaceutical benefits. In some embodiments, a pharmaceutically acceptable carrier comprises one or more compatible solid or liquid filler, diluents or encapsulating substances which are suitable for administration to a human or other vertebrate animal. In some embodiments, the pharmaceutical composition comprises a pharmaceutically acceptable carrier that is non-naturally occurring. In some embodiments, the pharmaceutically acceptable carrier and the active ingredient are not found together in nature and are thus, heterologous.

Pharmaceutical compositions used in the presently disclosed methods can be formulated with suitable carriers, excipients, and other agents that provide suitable transfer, delivery, tolerance, and the like. A multitude of appropriate formulations are known to those skilled in the art. See, e.g., Remington, The Science and Practice of Pharmacy (21st ed. 2005). Non-limiting examples include a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid or sodium bisulfate; chelating agents such as ethylenediaminetetraacetic acid; buffers such as acetates, citrates or phosphates and agents for the adjustment of tonicity such as sodium chloride or dextrose. Administered intravenously, particular carriers are physiological saline or phosphate buffered saline (PBS). Pharmaceutical compositions for oral or parenteral use may be prepared into dosage forms in a unit dose suited to fit a dose of the active ingredients. Such dosage forms in a unit dose include, for example, tablets, pills, capsules, injections (ampoules), suppositories, etc. These compositions also may contain adjuvants including preservative agents, wetting agents, emulsifying agents, and dispersing agents. Prevention of the action of microorganisms may be ensured by various antibacterial and antifungal agents, for example, parabens, chlorobutanol, phenol, sorbic acid, and the like. It also may be desirable to include isotonic agents, for example, sugars, sodium chloride and the like. Prolonged absorption of the injectable pharmaceutical form may be brought about by the use of agents delaying absorption, for example, aluminum monostearate and gelatin.

In some embodiments wherein cells comprising or modified with the presently disclosed RGNs, gRNAs, deaminases, fusion proteins, systems (including those comprising fusion proteins) or polynucleotides encoding the same are administered to a subject, the cells are administered as a suspension with a pharmaceutically acceptable carrier. One of skill in the art will recognize that a pharmaceutically acceptable carrier to be used in a cell composition will not include buffers, compounds, cryopreservation agents, preservatives, or other agents in amounts that substantially interfere with the viability of the cells to be delivered to the subject. A formulation comprising cells can include e.g., osmotic buffers that permit cell membrane integrity to be maintained, and optionally, nutrients to maintain cell viability or enhance engraftment upon administration. Such formulations and suspensions are known to those of skill in the art and/or can be adapted for use with the cells described herein using routine experimentation.

A cell composition can also be emulsified or presented as a liposome composition, provided that the emulsification procedure does not adversely affect cell viability. The cells and any other active ingredient can be mixed with excipients that are pharmaceutically acceptable and compatible with the active ingredient, and in amounts suitable for use in the therapeutic methods described herein.

Additional agents included in a cell composition can include pharmaceutically acceptable salts of the components therein. Pharmaceutically acceptable salts include the acid addition salts (formed with the free amino groups of the polypeptide) that are formed with inorganic acids, such as, for example, hydrochloric or phosphoric acids, or such organic acids as acetic, tartaric, mandelic and the like. Salts formed with the free carboxyl groups can also be derived from inorganic bases, such as, for example, sodium, potassium, ammonium, calcium or ferric hydroxides, and such organic bases as isopropylamine, trimethylamine, 2-ethylamino ethanol, histidine, procaine and the like.

Suitable routes of administrating the pharmaceutical composition described herein include, without limitation: topical, subcutaneous, transdermal, intradermal, intralesional, intraarticular, intraperitoneal, intravesical, transmucosal, gingival, intradental, intracochlear, transtympanic, intraorgan, epidural, intrathecal, intramuscular, intravenous, intravascular, intraosseus, periocular, intratumoral, intracerebral, and intracerebroventricular administration.

In some embodiments, the pharmaceutical composition described herein is administered locally to a diseased site (e.g., the lung). In some embodiments, the pharmaceutical composition described herein is administered to a subject by injection, inhalation (e.g., of an aerosol), by means of a catheter, by means of a suppository, or by means of an implant, the implant being of a porous, non-porous, or gelatinous material, including a membrane, such as a sialastic membrane, or a fiber. In some embodiments, the pharmaceutical composition is formulated for delivery to a subject, e.g., for gene editing.

In some embodiments, the pharmaceutical composition is formulated in accordance with routine procedures as a composition adapted for intravenous or subcutaneous administration to a subject, e.g., a human. In some embodiments, pharmaceutical composition for administration by injection are solutions in sterile isotonic aqueous buffer. Where necessary, the pharmaceutical can also include a solubilizing agent and a local anesthetic such as lignocaine to ease pain at the site of the injection. Generally, the ingredients are supplied either separately or mixed together, for example, as a dry lyophilized powder or water free concentrate in a hermetically sealed container such as an ampoule or sachette indicating the quantity of active agent. Where the pharmaceutical is to be administered by infusion, it can be dispensed with an infusion bottle containing sterile pharmaceutical grade water or saline. Where the pharmaceutical composition is administered by injection, an ampoule of sterile water for injection or saline can be provided so that the ingredients can be mixed prior to administration.

In some embodiments, the pharmaceutical composition can be contained within a lipid particle or vesicle, such as a liposome or microcrystal, which is also suitable for parenteral administration.

Although the descriptions of pharmaceutical compositions provided herein are principally directed to pharmaceutical compositions which are suitable for administration to humans, it will be understood by the skilled artisan that such compositions are generally suitable for administration to animals or organisms of all sorts.

Modifying Causal Mutations Using Base-Editing

An example of a genetically inherited disease which could be corrected using an approach that relies on an RGN-deaminase fusion protein of the invention is Cystic Fibrosis. Cystic fibrosis (CF) is an autosomal recessive disease caused by mutations in the cystic fibrosis transmembrane regulator (CFTR) gene (set forth as SEQ ID NO: 51). CFTR encodes for a cAMP regulated chloride channel located in the apical membrane of epithelial cells that catalyze the passage of small ions through the membrane. Dysregulation of this mechanism causes an impairment of salt and fluid homeostasis that results in multiorgan dysfunctions and ultimately mortality from respiratory failure.

Almost 2,000 mutations in the CFTR gene have been found to cause CF. CFTR mutations are divided into six classes based on the functional defect in either CFTR protein synthesis, trafficking, function, or stability, although it is acknowledged that many CFTR mutants present multiple defects. Class I mutations lead to severely defective protein production. They are primarily nonsense or frameshift mutations which introduce a premature termination codon (PTC), leading to unstable messenger RNA (mRNA) degraded by the mRNA decay pathway (NMD). Nonsense mutations due to single nucleotide changes comprise a major subset of Class I mutations (Marangi, M. and Pistritto, G, 2018, *Front Pharmacol* 9, 396, doi:10.3389/fphar.2018.00396; Pranke, I., et al., 2019, *Front Pharmacol* 10, 121, doi:10.3389/fphar.2019.00121, both of which are incorporated by reference herein). Treatment for patients with Class I cystic fibrosis can be difficult, as no functional CFTR protein is produced. Notably, a significant fraction of these nonsense mutations are potentially addressable with A to G base editors (Geurts, M. H. et al, 2020, *Cell Stem Cell* 26, 503-510 e507, doi:10.1016/j.stem.2020.01.019 incorporated by reference herein).

Geurts et al. were the first group to perform precise base editing in cultured lung epithelial cells with Class I mutations from cystic fibrosis patients, using a fusion protein comprising an adenine deaminase operably linked an RGN, namely either SpyCas9 or the xSpyCas9 variant. SpyCas9 recognizes a 5'-nGG-3'PAM, while the xSpyCas9 variant recognized the reduced 5'-nG-3'. The authors state that a major limitation of the base editing technology is the PAM requirement of the Cas protein being used. They find that the majority of nonsense mutations identified in the CFTR gene are not in the required targeting window for a fusion protein comprising the RGN SpyCas9. The PAM is a short motif, generally one to four nucleotides, on the target DNA sequence that is recognized by the RGN. The PAM sequence is intrinsic to each RGN protein, such that an RGN can only access the genomic space around a suitable PAM. Additionally, the base editing window for base editors is limited, frequently to just a portion of the nucleotides in the target sequence. If the nucleotide of interest is too close to the PAM, the RGN blocks access to the nucleotide. If the nucleotide is too far away from the PAM, the deaminase tethered to the RGN is unable to reach the nucleotide. Also, the amount of ssDNA exposed by the R-loop limits the accessibility of the deaminases. The present invention includes RGN-deaminase fusion proteins where the RGN recognizes a PAM which is proximal to a Class I mutation of the CFTR gene and the deaminase is able to successfully modify the targeted causal mutation.

Another limitation to RGN-deaminase fusion proteins known in the art is that the vector construct encoding for the fusion protein is too large for methods of in vivo delivery. AAV delivery of these fusion proteins is not an option for SpyCas9-based fusion proteins because their size exceeds the limit for efficient AAV packaging. The RGN component of the fusion proteins described herein are smaller in size and are therefore viable candidates for AAV vector delivery strategies. The present invention also discloses guide RNAs which are specific for the RGNs described herein and which guide the fusion proteins of the invention to target sites of nonsense mutations in the CFTR gene which were previously unreachable. The present invention also teaches methods of using said fusion proteins for targeted base editing through in vivo AAV vector delivery.

Ideally, the coding sequence of an RGN-deaminase fusion protein of the invention and a corresponding guide RNA for targeting the fusion protein to the CFTR gene may all be packaged into a single AAV vector. The generally accepted size limit for AAV vectors is 4.7 kb, although larger sizes may be contemplated at the expense of reduced packing efficiency. The RGN nickases in Table 28 have a coding sequence length of about 3.15-3.45 kB. To ensure that the expression cassettes for both the fusion protein and its corresponding guide RNA could fit into an AAV vector, novel, active deletion variants of RGNs are described herein. In addition to shortening the amino acid sequence and therefore the coding sequence of the RGN of the fusion protein, the peptide linker which links the RGN and the deaminase may also be shortened. Finally, the genetic elements, such as the promoters, enhancers, and/or terminators, may also be engineered via deletion analysis to determine the minimal size required for each to be functional.

Some embodiments of the disclosure provide methods for editing a nucleic acid using the deaminases or the RGN complexes described herein to achieve the nucleobase change, e.g., an A:T base pair to G:C base pair. In some embodiments, the method is a method for editing a nucleobase of a nucleic acid (e.g., a base pair of a double-stranded DNA sequence). In some embodiments, the deaminases or the RGN complexes described herein are used to introduce a point mutation into a nucleic acid by deaminating and excising a target "A" nucelobase. In some embodiments, the deamination-and-excision of the target nucleobase results in the correction of a genetic defect, e.g., in the correction of a point mutation in a CFTR gene. In some embodiments, the genetic defect is associated with a disease, disorder, or condition, e.g., Cystic Fibrosis. For example, in some embodiments, methods are provided herein employ a base editing RGN complexes comprising a fusion protein with a deaminase having an amino acid sequence that is at least 80% identical to sequence set forth in any one of the SEQ ID NOs: 399, and 405-407, to correct a gene associated with a genetic defect, e.g., to correct a point mutation in a CFTR gene (e.g., in the treatment of a proliferative disease). In specific embodiments, the target sequence in the CFTR gene is 62-97, 116-139, 152-185, 203-234, 251-286, 305-344, 562, or 563.

In some embodiments, the purpose of the methods provided herein is to restore the function of a dysfunctional gene via genome editing. The base editor proteins provided herein may be validated for gene editing-based human therapeutics in vitro, e.g., by correcting a disease-associated mutation in human cell culture. It will be understood by the skilled artisan that the fusion proteins and/or the RGN complexes provided herein comprising a nucleic acid binding protein (e.g., nCas9) and a nucleobase modification domain (e.g., deaminase with an amino acid sequence set forth in SEQ ID NO.: 407, 399, or 405 may be used to correct any single point of T to G or change a pairing of T:A to G:C.

In some embodiments, provided herein are the methods for the treatment of a subject diagnosed with a disease associated with or caused by a point mutation (e.g., mutation in CFTR gene) that can be corrected by a fusion protein or the RGN complexes described herein. For example, in some embodiments, a method is provided that comprises administering to a subject having such a disease, e.g., cystic fibrosis, an effective amount of a fusion protein or RGN complex disclosed herein that corrects the point mutation or introduces a deactivating mutation into a disease-associated gene. In some embodiments, a method is provided that comprises administering to a subject having such a disease, e.g., a cancer associated with a point mutation as described above, an effective amount of a fusion protein, RGN complex, or pharmaceutical composition disclosed herein that corrects the point mutation or introduces a deactivating mutation into a disease-associated gene. In specific embodiments, methods of treating cystic fibrosis are provided along with methods of reducing at least one symptom of cystic fibrosis by administering an effective amount of a pharmaceutical composition disclosed herein. An effective amount of a pharmaceutical composition for treating or reducing a symptom of cystic fibrosis can reduce a symptom (i.e., treat) of cystic fibrosis by about 5%, 10%, 15%20%, 25%, 30%, 40%, 50%, 60%, 70%, 80%, 90%, 95%, or more; or about 10-20%, 15-25%, 20-40%, 30-50%, 40-60%, 50-70%, 60-80%, 70-90%, 80-95%, or 90-95% when compared to a control patient. In specific embodiments, the control patient can be the same patient before administration of the effective amount of the pharmaceutical composition disclosed herein. Symptoms of cystic fibrosis can include, but are not limited to: sneezing, a persistent cough that produces mucus or phlegm, shortness of breath, especially when exercising, recurrent lung infections, a stuffy nose, stuffy sinuses, greasy foul-smelling stools, constipation, nausea, swollen abdomen, loss of appetite, among others. Methods of identifying and measuring symptoms of cystic fibrosis are known in the art.

In some embodiments of the described methods for modifying a target DNA molecule, the step of contacting is performed in vitro. In particular embodiments, the step of contacting is performed in vivo. In some embodiments, the step of contacting is performed in a subject (e.g., a human subject or a non-human animal subject). In some embodiments, the step of contacting is performed in a cell, such as a human or non-human animal cell.

XII. Cells Comprising a Polynucleotide Genetic Modification

Provided herein are cells and organisms comprising a target nucleic acid molecule of interest that has been modified using a process mediated by a fusion protein, optionally with a gRNA, as described herein. In some embodiments, the fusion protein comprises a deaminase polypeptide comprising an amino acid sequence of any of SEQ ID NOs: 1-10 and 399-441, or an active variant or fragment thereof. In some embodiments, the fusion protein comprises an adenine deaminase comprising an amino acid sequence having at least 50%, at least 55%, at least 60%, at least 65%, at least 70%, at least 75%, at least 80%, at least 85%, at least 90%, at least 95%, at least 96%, at least 97%, at least 98%, or at least 99% identity to any of SEQ ID NOs: 1-10 and 399-441. In some embodiments, the fusion protein comprises a deaminase and a DNA-binding polypeptide (e.g., an RNA-guided, DNA-binding polypeptide). In further embodiments, the fusion protein comprises a deaminase and an RGN or a variant thereof, such as for example APG07433.1 (SEQ ID NO: 41) or its nickase variant nAPG07433.1 (SEQ ID NO: 42). In some embodiments, the fusion protein comprises a deaminase and a Cas9 or a variant thereof, such as for example dCas9 or nickase Cas9. In some embodiments, the fusion protein comprises a nuclease-inactive or nickase variant of a Type II CRISPR-Cas polypeptide. In some embodiments, the fusion protein comprises a nuclease-inactive or nickase variant of a Type V CRISPR-Cas polypeptide. In some embodiments, the fusion protein comprises a nuclease-inactive or nickase variant of a Type VI CRISPR-Cas polypeptide.

The modified cells can be eukaryotic (e.g., mammalian, plant, insect, avian cell) or prokaryotic. Also provided are organelles and embryos comprising at least one nucleotide sequence that has been modified by a process utilizing a fusion protein as described herein. The genetically modified cells, organisms, organelles, and embryos can be heterozygous or homozygous for the modified nucleotide sequence. The mutation(s) introduced by the deaminase domain of the fusion protein can result in altered expression (up-regulation or down-regulation), inactivation, or the expression of an altered protein product or an integrated sequence. In those instances wherein the mutation(s) results in either the inactivation of a gene or the expression of a non-functional protein product, the genetically modified cell, organism, organelle, or embryo is referred to as a "knock out". The knock out phenotype can be the result of a deletion mutation (i.e., deletion of at least one nucleotide), an insertion mutation (i.e., insertion of at least one nucleotide), or a nonsense mutation (i.e., substitution of at least one nucleotide such that a stop codon is introduced).

In some embodiments, the mutation(s) introduced by the deaminase domain of the fusion protein results in the production of a variant protein product. The expressed variant protein product can have at least one amino acid substitution and/or the addition or deletion of at least one amino acid. The variant protein product can exhibit modified characteristics or activities when compared to the wild-type protein, including but not limited to altered enzymatic activity or substrate specificity.

In some embodiments, the mutation(s) introduced by the deaminase domain of the fusion protein result in an altered expression pattern of a protein. As a non-limiting example, mutation(s) in the regulatory regions controlling the expression of a protein product can result in the overexpression or downregulation of the protein product or an altered tissue or temporal expression pattern.

The cells that have been modified can be grown into an organism, such as a plant, in accordance with conventional ways. See, for example, McCormick et al. (1986) *Plant Cell Reports* 5:81-84. These plants may then be grown, and either pollinated with the same modified strain or different strains, and the resulting hybrid having the genetic modification. The present invention provides genetically modified seed. Progeny, variants, and mutants of the regenerated plants are also included within the scope of the invention, provided that these parts comprise the genetic modification. Further provided is a processed plant product or byproduct that retains the genetic modification, including for example, soymeal.

The methods provided herein may be used for modification of any plant species, including, but not limited to, monocots and dicots. Examples of plants of interest include, but are not limited to, corn (maize), sorghum, wheat, sunflower, tomato, crucifers, peppers, potato, cotton, rice, soybean, sugarbeet, sugarcane, tobacco, barley, and oilseed rape, *Brassica* sp., alfalfa, rye, millet, safflower, peanuts, sweet potato, cassava, coffee, coconut, pineapple, citrus trees, cocoa, tea, banana, avocado, fig, guava, mango, olive, papaya, cashew, macadamia, almond, oats, vegetables, ornamentals, and conifers.

Vegetables include, but are not limited to, tomatoes, lettuce, green beans, lima beans, peas, and members of the genus *Curcumis* such as cucumber, cantaloupe, and musk melon. Ornamentals include, but are not limited to, azalea, hydrangea, hibiscus, roses, tulips, daffodils, petunias, carnation, poinsettia, and chrysanthemum. Preferably, plants of the present invention are crop plants (for example, maize, sorghum, wheat, sunflower, tomato, crucifers, peppers, potato, cotton, rice, soybean, sugarbeet, sugarcane, tobacco, barley, oilseed rape, etc.).

The methods provided herein can also be used to genetically modify any prokaryotic species, including but not limited to, archaea and bacteria (e.g., *Bacillus* sp., *Klebsiella* sp. *Streptomyces* sp., *Rhizobium* sp., *Escherichia* sp., *Pseudomonas* sp., *Salmonella* sp., *Shigella* sp., *Vibrio* sp., *Yersinia* sp., *Mycoplasma* sp., *Agrobacterium*, *Lactobacillus* sp.).

The methods provided herein can be used to genetically modify any eukaryotic species or cells therefrom, including but not limited to animals (e.g., mammals, insects, fish, birds, and reptiles), fungi, amoeba, algae, and yeast. In some embodiments, the cell that is modified by the presently disclosed methods include cells of hematopoietic origin, such as immune cells (i.e., a cell of the innate or adaptive immune system) including but not limited to B cells, T cells, natural killer (NK) cells, pluripotent stem cells, induced pluripotent stem cells, chimeric antigen receptor T (CAR-T) cells, monocytes, macrophages, and dendritic cells.

Cells that have been modified may be introduced into an organism. These cells could have originated from the same organism (e.g., person) in the case of autologous cellular transplants, wherein the cells are modified in an ex vivo approach. In some embodiments, the cells originated from another organism within the same species (e.g., another person) in the case of allogeneic cellular transplants.

XIII. Kits

Some aspects of this disclosure provide kits comprising a deaminase of the invention. In certain embodiments, the disclosure provides kits comprising a fusion protein comprising a deaminase of the invention and a DNA-binding polypeptide (e.g., an RNA-guided, DNA-binding polypeptide, such as an RGN polypeptide, for example a nuclease-inactive Cas9 domain), and, optionally, a linker positioned between the DNA-binding polypeptide domain and the deaminase. In addition, in some embodiments, the kit comprises suitable reagents, buffers, and/or instructions for using the fusion protein, e.g., for in vitro or in vivo DNA or RNA editing. In some embodiments, the kit comprises instructions regarding the design and use of suitable gRNAs for targeted editing of a nucleic acid sequence.

In some embodiments, the pharmaceutical composition may be provided as a pharmaceutical kit comprising (a) a container containing a composition of the disclosure in lyophilized form and (b) a second container containing a pharmaceutically acceptable diluent (e.g., sterile water) for injection. The pharmaceutically acceptable diluent can be used for reconstitution or dilution of the lyophilized compound of the disclosure. Optionally associated with such container(s) can be a notice in the form prescribed by a governmental agency regulating the manufacture, use or sale of pharmaceuticals or biological products, which notice reflects approval by the agency of manufacture, use or sale for human administration.

The article "a" and "an" are used herein to refer to one or more than one (i.e., to at least one) of the grammatical object of the article. By way of example, "a polypeptide" means one or more polypeptides.

All publications and patent applications mentioned in the specification are indicative of the level of those skilled in the art to which this disclosure pertains. All publications and patent applications are herein incorporated by reference to the same extent as if each individual publication or patent application was specifically and individually indicated to be incorporated herein by reference.

Although the foregoing invention has been described in some detail by way of illustration and example for purposes of clarity of understanding, it will be obvious that certain changes and modifications may be practiced within the scope of the appended claims.

Non-limiting embodiments include:
1. An isolated polypeptide comprising an amino acid sequence having at least 90% sequence identity to any one of SEQ ID NOs: 407, 405, 399, 1-10, 400-404, 406, and 408-441, wherein said polypeptide has deaminase activity.
2. The isolated polypeptide of embodiment 1, comprising an amino acid sequence having at least 95% sequence identity to any one of SEQ ID NOs: 407, 405, 399, 1-10, 400-404, 406, and 408-441.
3. The isolated polypeptide of embodiment 1, comprising an amino acid sequence having 100% sequence identity to any one of SEQ ID NOs: 407, 405, 399, 1-10, 400-404, 406, and 408-441.
4. A nucleic acid molecule comprising a polynucleotide encoding a deaminase polypeptide, wherein the deaminase is encoded by a nucleotide sequence that:
a) has at least 80% sequence identity to any one of SEQ ID NOs: 451, 449, 443, 11-20, 444-448, 450, and 452-485, or
b) encodes an amino acid sequence having at least 90% sequence identity to any one of SEQ ID NOs: 407, 405, 399, 1-10, 400-404, 406, and 408-441.
5. The nucleic acid molecule of embodiment 4, wherein the deaminase is encoded by a nucleotide sequence that has at least 90% sequence identity to any one of SEQ ID NOs: 451, 449, 443, 11-20, 444-448, 450, and 452-485.
6. The nucleic acid molecule of embodiment 4, wherein the deaminase is encoded by a nucleotide sequence that has at least 95% sequence identity to any one of SEQ ID NOs: 451, 449, 443, 11-20, 444-448, 450, and 452-485.
7. The nucleic acid molecule of embodiment 4, wherein the deaminase is encoded by a nucleotide sequence that has 100% sequence identity to any one of SEQ ID NOs: 451, 449, 443, 11-20, 444-448, 450, and 452-485.
8. The nucleic acid molecule of embodiment 4, wherein the deaminase polypeptide has an amino acid sequence having at least 95% sequence identity to any one of SEQ ID NOs: 407, 405, 399, 1-10, 400-404, 406, and 408-441.
9. The nucleic acid molecule of embodiment 4, wherein the deaminase polypeptide has an amino acid sequence having 100% sequence identity to any one of SEQ ID NOs: 407, 405, 399, 1-10, 400-404, 406, and 408-441.
10. The nucleic acid molecule of any one of embodiments 4-9, wherein said nucleic acid molecule further comprises a heterologous promoter operably linked to said polynucleotide.
11. A pharmaceutical composition comprising a pharmaceutically acceptable carrier and the polypeptide of any one of embodiments of 1-3 or the nucleic acid molecule of any one of embodiments 4-10.
12. The pharmaceutical composition of embodiment 11, wherein the pharmaceutically acceptable carrier is heterologous to said polypeptide or said nucleic acid molecule.
13. The pharmaceutical composition of embodiment 11 or 12, wherein the pharmaceutically acceptable carrier is not naturally-occurring.
14. A fusion protein comprising a DNA-binding polypeptide and a deaminase having at least 90% sequence identity to any one of SEQ ID NOs: 407, 405, 399, 1-10, 400-404, 406, and 408-441.
15. The fusion protein of embodiment 14, wherein said deaminase has at least 95% sequence identity to any one of SEQ ID NOs: 407, 405, 399, 1-10, 400-404, 406, and 408-441.
16. The fusion protein of embodiment 14, wherein said deaminase has 100% sequence identity to any one of SEQ ID NOs: 407, 405, 399, 1-10, 400-404, 406, and 408-441.
17. The fusion protein of any one of embodiments 14-16, wherein the deaminase is an adenine deaminase.
18. The fusion protein of any one of embodiments 14-17, wherein the DNA-binding polypeptide is a meganuclease, zinc finger fusion protein, or a TALEN.
19. The fusion protein of any one of embodiments 14-17, wherein the DNA-binding polypeptide is an RNA-guided, DNA-binding polypeptide.
20. The fusion protein of embodiment 19, wherein the RNA-guided, DNA-binding polypeptide is an RNA-guided nuclease (RGN) polypeptide.
21. The fusion protein of embodiment 20, wherein the RGN is a Type II CRISPR-Cas polypeptide.
22. The fusion protein of embodiment 20, wherein the RGN is a Type V CRISPR-Cas polypeptide.
23. The fusion protein of any one of embodiments 20-22, wherein the RGN is an RGN nickase.
24. The fusion protein of embodiment 20, wherein the RGN has an amino acid sequence having at least 95% sequence identity to any one of SEQ ID NOs: 41, 60, 366, and 368.
25. The fusion protein of embodiment 20, wherein the RGN has an amino acid sequence of any one of SEQ ID NOs: 41, 60, 366, and 368.
26. The fusion protein of embodiment 23, wherein the RGN nickase is any one of SEQ ID NOs: 42, 52-59, 61, 397, and 398.
27. The fusion protein of any of embodiments 14-26, wherein the fusion protein further comprises at least one nuclear localization signal (NLS).
28. A nucleic acid molecule comprising a polynucleotide encoding a fusion protein comprising a DNA-binding polypeptide and a deaminase, wherein the deaminase is encoded by a nucleotide sequence that:
a) has at least 80% sequence identity to any one of SEQ ID NOs: 451, 449, 443, 11-20, 444-448, 450, and 452-485, or
b) encodes an amino acid sequence having at least 90% sequence identity to any one of SEQ ID NOs: 407, 405, 399, 1-10, 400-404, 406, and 408-441.
29. The nucleic acid molecule of embodiment 28, wherein said nucleotide sequence has at least 90% sequence identity to any one of SEQ ID NOs: 451, 449, 443, 11-20, 444-448, 450, and 452-485.
30. The nucleic acid molecule of embodiment 28, wherein said nucleotide sequence has at least 95% sequence identity to any one of SEQ ID NOs: 451, 449, 443, 11-20, 444-448, 450, and 452-485.
31. The nucleic acid molecule of embodiment 28, wherein said nucleotide sequence has 100% sequence identity to any one of SEQ ID NOs: 451, 449, 443, 11-20, 444-448, 450, and 452-485.
32. The nucleic acid molecule of embodiment 28, wherein said nucleotide sequence encodes an amino acid sequence having at least 95% sequence identity to any one of SEQ ID NOs 407, 405, 399, 1-10, 400-404, 406, and 408-441.
33. The nucleic acid molecule of embodiment 28, wherein said nucleotide sequence encodes an amino acid sequence having 100% sequence identity to any one of SEQ ID NOs: 407, 405, 399, 1-10, 400-404, 406, and 408-441.

34. The nucleic acid molecule of any one of embodiments 28-33, wherein the deaminase is an adenine deaminase.
35. The nucleic acid molecule of any one of embodiments 28-34, wherein the DNA-binding polypeptide is a meganuclease, zinc finger fusion protein, or a TALEN.
36. The nucleic acid molecule of any one of embodiments 28-34, wherein the DNA-binding polypeptide is an RNA-guided, DNA-binding polypeptide.
37. The nucleic acid molecule of embodiment 36, wherein the RNA-guided, DNA-binding polypeptide is an RNA-guided nuclease (RGN) polypeptide.
38. The nucleic acid molecule of embodiment 37, wherein the RGN is a Type II CRISPR-Cas polypeptide.
39. The nucleic acid molecule of embodiment 37, wherein the RGN is a Type V CRISPR-Cas polypeptide.
40. The nucleic acid molecule of any one of embodiments 37-39, wherein the RGN is an RGN nickase.
41. The nucleic acid molecule of embodiment 37, wherein the RGN has an amino acid sequence having at least 95% sequence identity to any one of SEQ ID NOs: 41, 60, 366, and 368.
42. The nucleic acid molecule of embodiment 37, wherein the RGN is SEQ ID NO: 41, 60, 366, or 368.
43. The nucleic acid molecule of embodiment 40, wherein the RGN nickase is any one of SEQ ID NOs: 42, 52-59, 61, 397, and 398.
44. The nucleic acid molecule of any of embodiments 28-43, wherein the polynucleotide encoding the fusion protein is operably linked at its 5' end to a heterologous promoter.
45. The nucleic acid molecule of any of embodiments 28-44, wherein the polynucleotide encoding the fusion protein is operably linked at its 3' end to a heterologous terminator.
46. The nucleic acid molecule of any of embodiments 28-45, wherein the fusion protein comprises one or more nuclear localization signals.
47. The nucleic acid molecule of any of embodiments 28-46, wherein the fusion protein is codon optimized for expression in a eukaryotic cell.
48. The nucleic acid molecule of any of embodiments 28-46, wherein the fusion protein is codon optimized for expression in a prokaryotic cell.
49. A vector comprising the nucleic acid molecule of any one of embodiments 28-48.
50. A vector comprising the nucleic acid molecule of any one of embodiments 28-48, further comprising at least one nucleotide sequence encoding a guide RNA (gRNA) capable of hybridizing to a target sequence.
51. The vector of embodiment 50, wherein the gRNA is a single guide RNA.
52. The vector of embodiment 50, wherein the gRNA is a dual guide RNA.
53. A cell comprising the fusion protein of any of embodiments 14-27.
54. A cell comprising the fusion protein of any one of embodiments 14-27, wherein the cell further comprises a guide RNA.
55. A cell comprising the nucleic acid molecule of any one of embodiments 28-48.
56. A cell comprising the vector of embodiments of any one of embodiments 49-52.
57. The cell of any one of embodiments 53-56, wherein the cell is a prokaryotic cell.
58. The cell of any one of embodiments 53-56, wherein the cell is a eukaryotic cell.
59. The cell of embodiment 58, wherein the eukaryotic cell is a mammalian cell.
60. The cell of embodiment 59, wherein the mammalian cell is a human cell.
61. The cell of embodiment 60, wherein the human cell is an immune cell.
62. The cell of embodiment 61, wherein the immune cell is a stem cell.
63. The cell of embodiment 62, wherein the stem cell is an induced pluripotent stem cell.
64. The cell of embodiment 58, wherein the eukaryotic cell is an insect or avian cell.
65. The cell of embodiment 58, wherein the eukaryotic cell is a fungal cell.
66. The cell of embodiment 58, wherein the eukaryotic cell is a plant cell.
67. A plant comprising the cell of embodiment 66.
68. A seed comprising the cell of embodiment 66.
69. A pharmaceutical composition comprising a pharmaceutically acceptable carrier and the fusion protein of any one of embodiments 14-27, the nucleic acid molecule of any one of embodiments 28-48, the vector of any one of embodiments 49-52, or the cell of any one of embodiments 59-63.
70. A method for making a fusion protein comprising culturing the cell of any one of embodiments 53-66 under conditions in which the fusion protein is expressed.
71. A method for making a fusion protein comprising introducing into a cell the nucleic acid molecule of any of embodiments 28-48 or a vector of any one of embodiments 49-52 and culturing the cell under conditions in which the fusion protein is expressed.
72. The method of embodiment 70 or 71, further comprising purifying said fusion protein.
73. A method for making an RGN fusion ribonucleoprotein complex, comprising introducing into a cell the nucleic acid molecule of any one of embodiments 37-43 and a nucleic acid molecule comprising an expression cassette encoding for a guide RNA, or the vector of any of embodiments 50-52, and culturing the cell under conditions in which the fusion protein and the gRNA are expressed and form an RGN fusion ribonucleoprotein complex.
74. The method of embodiment 73, further comprising purifying said RGN fusion ribonucleoprotein complex.
75. A system for modifying a target DNA molecule comprising a target DNA sequence, said system comprising:
   a) a fusion protein comprising an RNA-guided nuclease polypeptide (RGN) and a deaminase, wherein the deaminase has an amino acid sequence having at least 90% sequence identity to any one of SEQ ID NOs: 407, 405, 399, 1-10, 400-404, 406, and 408-441, or a nucleotide sequence encoding said fusion protein; and
   b) one or more guide RNAs capable of hybridizing to said target DNA sequence or one or more nucleotide sequences encoding the one or more guide RNAs (gRNAs); and
wherein the one or more guide RNAs are capable of forming a complex with the fusion protein in order to direct said fusion protein to bind to said target DNA sequence and modify the target DNA molecule.
76. The system of embodiment 75, wherein said deaminase has an amino acid sequence having at least 95% sequence identity to any one of SEQ ID NOs: 407, 405, 399, 1-10, 400-404, 406, and 408-441.

77. The system of embodiment 75, wherein said deaminase has an amino acid sequence having 100% sequence identity to any one of SEQ ID NOs: 407, 405, 399, 1-10, 400-404, 406, and 408-441.

78. The system of any one of embodiments 75-77, wherein at least one of said nucleotide sequence encoding the one or more guide RNAs and said nucleotide sequence encoding the fusion protein is operably linked to a promoter heterologous to said nucleotide sequence.

79. The system of any one of embodiments 75-78, wherein the target DNA sequence is a eukaryotic target DNA sequence.

80. The system of any one of embodiments 75-79, wherein the target DNA sequence is located adjacent to a protospacer adjacent motif (PAM) that is recognized by the RGN.

81. The system of any one of embodiments 75-80, wherein the target DNA molecule is within a cell.

82. The system of embodiment 81, wherein the cell is a eukaryotic cell.

83. The system of embodiment 82, wherein the eukaryotic cell is a plant cell.

84. The system of embodiment 82, wherein the eukaryotic cell is a mammalian cell.

85. The system of embodiment 84, wherein the mammalian cell is a human cell.

86. The system of embodiment 85, wherein the human cell is an immune cell.

87. The system of embodiment 86, wherein the immune cell is a stem cell.

88. The system of embodiment 87, wherein the stem cell is an induced pluripotent stem cell.

89. The system of embodiment 82, wherein the eukaryotic cell is an insect cell.

90. The system of embodiment 81, wherein the cell is a prokaryotic cell.

91. The system of any one of embodiments 75-90, wherein the RGN of the fusion protein is a Type II CRISPR-Cas polypeptide.

92. The system of any one of embodiments 75-90, wherein the RGN of the fusion protein is a Type V CRISPR-Cas polypeptide.

93. The system of any one of embodiments 75-90, wherein the RGN of the fusion protein has an amino acid sequence having at least 95% sequence identity to SEQ ID NO: 41, 60, 366, or 368.

94. The system of any one of embodiments 75-90, wherein the RGN of the fusion protein has an amino acid sequence of any one of SEQ ID NOs: 41, 60, 366, and 368.

95. The system of any one of embodiments 75-90, wherein the RGN of the fusion protein is an RGN nickase.

96. The system of embodiment 95, wherein the RGN nickase is any one of SEQ ID NOs: 42, 52-59, 61, 397, and 398.

97. The system of any of embodiments 75-96, wherein the fusion protein comprises one or more nuclear localization signals.

98. The system of any of embodiments 75-97, wherein the fusion protein is codon optimized for expression in a eukaryotic cell.

99. The system of any of embodiments 75-98, wherein nucleotide sequences encoding the one or more guide RNAs and the nucleotide sequence encoding a fusion protein are located on one vector.

100. A pharmaceutical composition comprising a pharmaceutically acceptable carrier and the system of any one of embodiments 75-99.

101. A method for modifying a target DNA molecule comprising a target DNA sequence, said method comprising delivering a system according to any one of embodiments 75-99 to said target DNA molecule or a cell comprising the target DNA molecule.

102. The method of embodiment 101, wherein said modified target DNA molecule comprises an A>N mutation of at least one nucleotide within the target DNA molecule, wherein N is C, G, or T.

103. The method of embodiment 102, wherein said modified target DNA molecule comprises an A>G mutation of at least one nucleotide within the target DNA molecule.

104. A method for modifying a target DNA molecule comprising a target sequence comprising:
a) assembling an RGN-deaminase ribonucleotide complex in vitro by combining:
  i) one or more guide RNAs capable of hybridizing to the target DNA sequence; and
  ii) a fusion protein comprising an RNA-guided nuclease polypeptide (RGN), and at least one deaminase, wherein the deaminase has an amino acid sequence having at least 90% sequence identity to any one of SEQ ID NOs: 407, 405, 399, 1-10, 400-404, 406, and 408-441;
under conditions suitable for formation of the RGN-deaminase ribonucleotide complex; and
b) contacting said target DNA molecule or a cell comprising said target DNA molecule with the in vitro-assembled RGN-deaminase ribonucleotide complex;
wherein the one or more guide RNAs hybridize to the target DNA sequence, thereby directing said fusion protein to bind to said target DNA sequence and modification of the target DNA molecule occurs.

105. The method of embodiment 104, wherein said deaminase has an amino acid sequence having at least 95% sequence identity to any one of SEQ ID NOs: 407, 405, 399, 1-10, 400-404, 406, and 408-441.

106. The method of embodiment 104, wherein said deaminase has an amino acid sequence having 100% sequence identity to any one of SEQ ID NOs: 407, 405, 399, 1-10, 400-404, 406, and 408-441.

107. The method of any one of embodiments 104-106, wherein said modified target DNA molecule comprises an A>N mutation of at least one nucleotide within the target DNA molecule, wherein N is C, G, or T.

108. The method of embodiment 107, wherein said modified target DNA molecule comprises an A>G mutation of at least one nucleotide within the target DNA molecule.

109. The method of any one of embodiments 104-108, wherein the RGN of the fusion protein is a Type II CRISPR-Cas polypeptide.

110. The method of any of embodiments 104-108, wherein the RGN of the fusion protein is a Type V CRISPR-Cas polypeptide.

111. The method of any of embodiments 104-108, wherein the RGN of the fusion protein has an amino acid sequence having at least 95% sequence identity to SEQ ID NO: 41, 60, 366, or 368.

112. The method of any one of embodiments 104-108, wherein the RGN of the fusion protein has an amino acid sequence of any one of SEQ ID NOs: 41, 60, 366, and 368.

113. The method of any of embodiments 104-108, wherein the RGN of the fusion protein is an RGN nickase.

114. The method of embodiment 113, wherein the RGN nickase is any one of SEQ ID NOs: 42, 52-59, 61, 397, and 398.

115. The method of any of embodiments 104-114, wherein the fusion protein comprises one or more nuclear localization signals.

116. The method of any of embodiments 104-115, wherein the fusion protein is codon optimized for expression in a eukaryotic cell.

117. The method of any one of embodiments 104-116, wherein said target DNA sequence is a eukaryotic target DNA sequence.

118. The method of any of embodiments 104-117, wherein said target DNA sequence is located adjacent to a protospacer adjacent motif (PAM).

119. The method of any of embodiments 104-118, wherein the target DNA molecule is within a cell.

120. The method of embodiment 119, wherein the cell is a eukaryotic cell.

121. The method of embodiment 120, wherein the eukaryotic cell is a plant cell.

122. The method of embodiment 120, wherein the eukaryotic cell is a mammalian cell.

123. The method of embodiment 122, wherein the mammalian cell is a human cell.

124. The method of embodiment 123, wherein the human cell is an immune cell.

125. The method of embodiment 124, wherein the immune cell is a stem cell.

126. The method of embodiment 125, wherein the stem cell is an induced pluripotent stem cell.

127. The method of embodiment 120, wherein the eukaryotic cell is an insect cell.

128. The method of embodiment 119, wherein the cell is a prokaryotic cell.

129. The method of any one of embodiments 119-128, further comprising selecting a cell comprising said modified DNA molecule.

130. A cell comprising a modified target DNA sequence according to the method of embodiment 129.

131. The cell of embodiment 130, wherein the cell is a eukaryotic cell.

132. The cell of embodiment 131, wherein the eukaryotic cell is a plant cell.

133. A plant comprising the cell of embodiment 132.

134. A seed comprising the cell of embodiment 132.

135. The cell of embodiment 131, wherein the eukaryotic cell is a mammalian cell.

136. The cell of embodiment 135, wherein the mammalian cell is a human cell.

137. The cell of embodiment 136, wherein the human cell is an immune cell.

138. The cell of embodiment 137, wherein the immune cell is a stem cell.

139. The cell of embodiment 138, wherein the stem cell is an induced pluripotent stem cell.

140. The cell of embodiment 131, wherein the eukaryotic cell is an insect cell.

141. The cell of embodiment 130, wherein the cell is a prokaryotic cell.

142. A pharmaceutical composition comprising the cell of any one of embodiments 135-139, and a pharmaceutically acceptable carrier.

143. A method for producing a genetically modified cell with a correction in a causal mutation for a genetically inherited disease, the method comprising introducing into the cell:
a) a fusion protein comprising an RNA-guided nuclease polypeptide (RGN) and a deaminase, wherein the deaminase has an amino acid sequence having at least 90% sequence identity to any one of SEQ ID NOs: 407, 405, 399, 1-10, 400-404, 406, and 408-441, or a polynucleotide encoding said fusion protein, wherein said polynucleotide encoding the fusion protein is operably linked to a promoter to enable expression of the fusion protein in the cell; and
b) one or more guide RNAs (gRNA) capable of hybridizing to a target DNA sequence, or a polynucleotide encoding said gRNA, wherein said polynucleotide encoding the gRNA is operably linked to a promoter to enable expression of the gRNA in the cell;
whereby the fusion protein and gRNA target to the genomic location of the causal mutation and modify the genomic sequence to remove the causal mutation.

144. The method of embodiment 143, wherein said deaminase has an amino acid sequence having at least 95% sequence identity to any one of SEQ ID NOs: 407, 405, 399, 1-10, 400-404, 406, and 408-441.

145. The method of embodiment 143, wherein said deaminase has an amino acid sequence having 100% sequence identity to any one of SEQ ID NOs: 407, 405, 399, 1-10, 400-404, 406, and 408-441.

146. The method of any one of embodiments 143-145, wherein said RGN of the fusion protein is an RGN nickase.

147. The method of embodiment 146, wherein the RGN nickase is any one of SEQ ID NOs: 42, 52-59, 61, 397, and 398.

148. The method of any of embodiments 143-147, wherein the genome modification comprises introducing an A>G mutation of at least one nucleotide within the target DNA sequence.

149. The method of any of embodiments 143-148, wherein the cell is an animal cell.

150. The method of embodiment 149, wherein the animal cell is a mammalian cell.

151. The method of embodiment 150, wherein the cell is derived from a dog, cat, mouse, rat, rabbit, horse, sheep, goat, cow, pig, or human.

152. The method of any one of embodiments 143-151, wherein the correction of the causal mutation comprises correcting a nonsense mutation.

153. The method of embodiment 149, wherein the genetically inherited disease is a disease listed in Table 34.

154. The method of embodiment 149, wherein the genetically inherited disease is cystic fibrosis.

155. The method of embodiment 154, wherein the gRNA further comprises a spacer sequence that targets any one of SEQ ID NOs: 62-97, 116-139, 152-185, 203-234, 251-286, 305-344, 562, and 563, or the complement thereof.

156. The method of embodiment 155, wherein the gRNA comprises any one of SEQ ID NOs: 98-115, 140-151, 186-202, 235-250, 287-304, 345-364, and 564.

157. A CRISPR RNA (crRNA) or a nucleic acid molecule encoding the same, wherein said CRISPR RNA comprises a spacer sequence that targets a target DNA sequence within a cystic fibrosis transmembrane conductance regulator (CFTR) gene, wherein said target sequence has the sequence set forth as any one of SEQ ID NOs: 98-115, 140-151, 186-202, 235-250, 287-304, 345-364, 562, and 563, or the complement thereof.

158. A guide RNA comprising the crRNA of embodiment 157.

159. The guide RNA of embodiment 158, wherein said guide RNA is a dual-guide RNA.

160. The guide RNA of embodiment 158, wherein said guide RNA is a single guide RNA (sgRNA).

161. The guide RNA of embodiment 160, wherein said sgRNA has at least 90% sequence identity to any one of SEQ ID NOs: 98-115, 140-151, 186-202, 235-250, 287-304, 345-364, and 564.

162. The guide RNA of embodiment 160, wherein said sgRNA has at least 95% sequence identity to any one of SEQ ID NOs: 98-115, 140-151, 186-202, 235-250, 287-304, 345-364, and 564.

163. The guide RNA of embodiment 160, wherein said sgRNA has the sequence set forth as any one of SEQ ID NOs: 98-115, 140-151, 186-202, 235-250, 287-304, 345-364, and 564.

164. A vector comprising one or more nucleic acid molecules encoding said guide RNA of any one of embodiments 158-163.

165. A system for binding a target DNA sequence of a DNA molecule, said system comprising:
  a) one or more guide RNAs capable of hybridizing to said target DNA sequence or one or more polynucleotides comprising one or more nucleotide sequences encoding the one or more guide RNAs (gRNAs); and
  b) a fusion protein comprising an RNA-guided nuclease polypeptide (RGN) and an adenine deaminase, or a polynucleotide comprising a nucleotide sequence encoding the fusion protein;
  wherein the one or more guide RNAs are capable of hybridizing to the target DNA sequence,
  wherein the one or more guide RNAs are capable of forming a complex with the RGN polypeptide in order to direct said RGN polypeptide to bind to said target DNA sequence of the DNA molecule, and
wherein at least one guide RNA comprises a CRISPR RNA (crRNA) comprising a spacer sequence that targets a target DNA sequence within a cystic fibrosis transmembrane conductance regulator (CFTR) gene, wherein said target sequence has the sequence set forth as any one of SEQ ID NOs: 98-115, 140-151, 186-202, 235-250, 287-304, 345-364, 562, and 563, or the complement thereof.

166. The system of embodiment 165, wherein at least one of said nucleotide sequences encoding the one or more guide RNAs and said nucleotide sequence encoding the fusion protein is operably linked to a promoter heterologous to said nucleotide sequence.

167. A system for binding a target DNA sequence of a DNA molecule, said system comprising:
  a) one or more guide RNAs capable of hybridizing to said target DNA sequence or one or more polynucleotides comprising one or more nucleotide sequences encoding the one or more guide RNAs (gRNAs); and
  b) a fusion protein comprising an RNA-guided nuclease polypeptide (RGN) and an adenine deaminase;
wherein the one or more guide RNAs are capable of hybridizing to the target DNA sequence, wherein the one or more guide RNAs are capable of forming a complex with the RGN polypeptide in order to direct said RGN polypeptide to bind to said target DNA sequence of the DNA molecule, and
wherein at least one guide RNA comprises a CRISPR RNA (crRNA) comprising a spacer sequence that targets a target DNA sequence within a cystic fibrosis transmembrane conductance regulator (CFTR) gene, wherein said target sequence has the sequence set forth as any one of SEQ ID NOs: 98-115, 140-151, 186-202, 235-250, 287-304, 345-364, 562, and 563, or the complement thereof.

168. The system of embodiment 167, wherein at least one of said nucleotide sequences encoding the one or more guide RNAs is operably linked to a promoter heterologous to said nucleotide sequence.

169. The system of any one of embodiments 165-168, wherein the deaminase has an amino acid sequence having at least 90% sequence identity to any one of SEQ ID NOs: 1-10 and 399-441.

170. The system of any one of embodiments 165-168, wherein the deaminase has an amino acid sequence having at least 95% sequence identity to any one of SEQ ID NOs: 1-10 and 399-441.

171. The system of any one of embodiments 165-168, wherein the deaminase has an amino acid sequence having the sequence set forth in any one of SEQ ID NOs: 1-10 and 399-441.

172. The system of any one of embodiments 165-171, wherein said RGN polypeptide and said one or more guide RNAs are not found complexed to one another in nature.

173. The system of any one of embodiments 165-172, wherein:
a) said target DNA sequence has the sequence set forth as any one of SEQ ID NOs: 62-68, 80-85, 116-119, 128-131, 163, 164, 180, 181, 203-209, 219-225, 256-258, 274-276, 310-313, and 330-333, or the complement thereof, and wherein said RGN polypeptide has a sequence having at least 90% sequence identity to SEQ ID NO: 53;
b) said target DNA sequence has the sequence set forth as any one of SEQ ID NOs: 68-71, 86-89, 120-122, 132-134, 152-156, 169-173, 213-215, 229-231, 251-255, 269-273, 305-309, and 325-329, or the complement thereof, and wherein said RGN polypeptide has a sequence having at least 90% sequence identity to SEQ ID NO: 55;
c) said target DNA sequence has the sequence set forth as any one of SEQ ID NOs: 72, 73, 90, 91, 161, 162, 178, 179, 265, 266, 283, and 284 or the complement thereof, and wherein said RGN polypeptide has a sequence having at least 90% sequence identity to SEQ ID NO: 52;
d) said target DNA sequence has the sequence set forth as any one of SEQ ID NOs: 74, 75, 92, 93, 123, 124, 135, 136, 167, 184, 216-218, 232-234, 259-261, 277-279, 314-317, and 334-337, or the complement thereof, and wherein said RGN polypeptide has a sequence having at least 90% sequence identity to SEQ ID NO: 56;
e) said target DNA sequence has the sequence set forth as any one of SEQ ID NOs: 76, 94, 210-212, 226-228, 322, 342, 562, and 563, or the complement thereof, and wherein said RGN polypeptide has a sequence having at least 90% sequence identity to SEQ ID NO: 42;
f) said target DNA sequence has the sequence set forth as any one of SEQ ID NOs: 77, 95, 125, 137, 157-160, 174-177, 323, and 343, or the complement thereof, and wherein said RGN polypeptide has a sequence having at least 90% sequence identity to SEQ ID NO: 54;

g) said target DNA sequence has the sequence set forth as any one of SEQ ID NOs: 78, 96, 126, 138, 168, 185, 267, 285, 318, 319, 338, and 339, or the complement thereof, and wherein said RGN polypeptide has a sequence having at least 90% sequence identity to SEQ ID NO: 57;

h) said target DNA sequence has the sequence set forth as any one of SEQ ID NOs: 79, 97, 127, 139, 262-264, 280-282, 324, and 344, or the complement thereof, and wherein said RGN polypeptide has a sequence having at least 90% sequence identity to SEQ ID NO: 58; and i) said target DNA sequence has the sequence set forth as any one of SEQ ID NOs: 165, 166, 182, 183, 268, 286, 320, 321, 340, and 341, or the complement thereof, and wherein said RGN polypeptide has a sequence having at least 90% sequence identity to SEQ ID NO: 59.

174. The system of any one of embodiments 165-172, wherein:

a) said target DNA sequence has the sequence set forth as any one of SEQ ID NOs: 62-68, 80-85, 116-119, 128-131, 163, 164, 180, 181, 203-209, 219-225, 256-258, 274-276, 310-313, and 330-333, or the complement thereof, and wherein said RGN polypeptide has a sequence having at least 95% sequence identity to SEQ ID NO: 53;

b) said target DNA sequence has the sequence set forth as any one of SEQ ID NOs: 68-71, 86-89, 120-122, 132-134, 152-156, 169-173, 213-215, 229-231, 251-255, 269-273, 305-309, and 325-329, or the complement thereof, and wherein said RGN polypeptide has a sequence having at least 95% sequence identity to SEQ ID NO: 55;

c) said target DNA sequence has the sequence set forth as any one of SEQ ID NOs: 72, 73, 90, 91, 161, 162, 178, 179, 265, 266, 283, and 284 or the complement thereof, and wherein said RGN polypeptide has a sequence having at least 95% sequence identity to SEQ ID NO: 52;

d) said target DNA sequence has the sequence set forth as any one of SEQ ID NOs: 74, 75, 92, 93, 123, 124, 135, 136, 167, 184, 216-218, 232-234, 259-261, 277-279, 314-317, and 334-337, or the complement thereof, and wherein said RGN polypeptide has a sequence having at least 95% sequence identity to SEQ ID NO: 56;

e) said target DNA sequence has the sequence set forth as any one of SEQ ID NOs: 76, 94, 210-212, 226-228, 322, 342, 562, and 563, or the complement thereof, and wherein said RGN polypeptide has a sequence having at least 95% sequence identity to SEQ ID NO: 42;

f) said target DNA sequence has the sequence set forth as any one of SEQ ID NOs: 77, 95, 125, 137, 157-160, 174-177, 323, and 343, or the complement thereof, and wherein said RGN polypeptide has a sequence having at least 95% sequence identity to SEQ ID NO: 54;

g) said target DNA sequence has the sequence set forth as any one of SEQ ID NOs: 78, 96, 126, 138, 168, 185, 267, 285, 318, 319, 338, and 339, or the complement thereof, and wherein said RGN polypeptide has a sequence having at least 95% sequence identity to SEQ ID NO: 57;

h) said target DNA sequence has the sequence set forth as any one of SEQ ID NOs: 79, 97, 127, 139, 262-264, 280-282, 324, and 344, or the complement thereof, and wherein said RGN polypeptide has a sequence having at least 95% sequence identity to SEQ ID NO: 58; and i) said target DNA sequence has the sequence set forth as any one of SEQ ID NOs: 165, 166, 182, 183, 268, 286, 320, 321, 340, and 341, or the complement thereof, and wherein said RGN polypeptide has a sequence having at least 95% sequence identity to SEQ ID NO: 59.

175. The system of any one of embodiments 165-172, wherein:

a) said target DNA sequence has the sequence set forth as any one of SEQ ID NOs: 62-68, 80-85, 116-119, 128-131, 163, 164, 180, 181, 203-209, 219-225, 256-258, 274-276, 310-313, and 330-333, or the complement thereof, and wherein said RGN polypeptide has a sequence having 100% sequence identity to SEQ ID NO: 53;

b) said target DNA sequence has the sequence set forth as any one of SEQ ID NOs: 68-71, 86-89, 120-122, 132-134, 152-156, 169-173, 213-215, 229-231, 251-255, 269-273, 305-309, and 325-329, or the complement thereof, and wherein said RGN polypeptide has a sequence having 100% sequence identity to SEQ ID NO: 55;

c) said target DNA sequence has the sequence set forth as any one of SEQ ID NOs: 72, 73, 90, 91, 161, 162, 178, 179, 265, 266, 283, and 284 or the complement thereof, and wherein said RGN polypeptide has a sequence having 100% sequence identity to SEQ ID NO: 52;

d) said target DNA sequence has the sequence set forth as any one of SEQ ID NOs: 74, 75, 92, 93, 123, 124, 135, 136, 167, 184, 216-218, 232-234, 259-261, 277-279, 314-317, and 334-337, or the complement thereof, and wherein said RGN polypeptide has a sequence having 100% sequence identity to SEQ ID NO: 56;

e) said target DNA sequence has the sequence set forth as any one of SEQ ID NOs: 76, 94, 210-212, 226-228, 322, 342, 562, and 563, or the complement thereof, and wherein said RGN polypeptide has a sequence having 100% sequence identity to SEQ ID NO: 42;

f) said target DNA sequence has the sequence set forth as any one of SEQ ID NOs: 77, 95, 125, 137, 157-160, 174-177, 323, and 343, or the complement thereof, and wherein said RGN polypeptide has a sequence having 100% sequence identity to SEQ ID NO: 54;

g) said target DNA sequence has the sequence set forth as any one of SEQ ID NOs: 78, 96, 126, 138, 168, 185, 267, 285, 318, 319, 338, and 339, or the complement thereof, and wherein said RGN polypeptide has a sequence having 100% sequence identity to SEQ ID NO: 57;

h) said target DNA sequence has the sequence set forth as any one of SEQ ID NOs: 79, 97, 127, 139, 262-264, 280-282, 324, and 344, or the complement thereof, and wherein said RGN polypeptide has a sequence having 100% sequence identity to SEQ ID NO: 58; and i) said target DNA sequence has the sequence set forth as any one of SEQ ID NOs: 165, 166, 182, 183, 268, 286, 320, 321, 340, and 341, or the complement thereof, and wherein said RGN polypeptide has a sequence having 100% sequence identity to SEQ ID NO: 59.

176. The system of any one of embodiments 165-175, wherein at least one guide RNA is a dual-guide RNA.

177. The system of any one of embodiments 165-175, wherein at least one guide RNA is a single guide RNA (sgRNA).

178. The system of embodiment 177, wherein:
a) said sgRNA has at least 90% sequence identity to any one of SEQ ID NOs: 98-104, 140-143, 197, 198, 235-241, 292-294, and 350-353, and wherein said RGN polypeptide has a sequence having at least 90% sequence identity to SEQ ID NO: 53;
b) said sgRNA has at least 90% sequence identity to any one of SEQ ID NOs: 104-107, 144-146, 186-190, 245-247, 287-291, and 345-349, and wherein said RGN polypeptide has a sequence having at least 90% sequence identity to SEQ ID NO: 55;
c) said sgRNA has at least 90% sequence identity to any one of SEQ ID NOs: 108, 109, 195, 196, 301, and 302, and wherein said RGN polypeptide has a sequence having at least 90% sequence identity to SEQ ID NO: 52;
d) said sgRNA has at least 90% sequence identity to any one of SEQ ID NOs: 110, 111, 147, 148, 201, 248-250, 295-297, and 354-357, and wherein said RGN polypeptide has a sequence having at least 90% sequence identity to SEQ ID NO: 56;
e) said sgRNA has at least 90% sequence identity to any one of SEQ ID NOs: 112, 242-244, 362, and 564, and wherein said RGN polypeptide has a sequence having at least 90% sequence identity to SEQ ID NO: 42;
f) said sgRNA has at least 90% sequence identity to any one of SEQ ID NOs: 113, 149, 191-194, and 363, and wherein said RGN polypeptide has a sequence having at least 90% sequence identity to SEQ ID NO: 54;
g) said sgRNA has at least 90% sequence identity to any one of SEQ ID NOs: 114, 150, 202, 303, 358, and 359, and wherein said RGN polypeptide has a sequence having at least 90% sequence identity to SEQ ID NO: 57;
h) said sgRNA has at least 90% sequence identity to any one of SEQ ID NOs: 115, 151, 298-300, and 364, and wherein said RGN polypeptide has a sequence having at least 90% sequence identity to SEQ ID NO: 58; and
i) said sgRNA has at least 90% sequence identity to any one of SEQ ID NOs: 199, 200, 304, 360, and 361, and wherein said RGN polypeptide has a sequence having at least 90% sequence identity to SEQ ID NO: 59.

179. The system of embodiment 177, wherein:
a) said sgRNA has at least 95% sequence identity to any one of SEQ ID NOs: 98-104, 140-143, 197, 198, 235-241, 292-294, and 350-353, and wherein said RGN polypeptide has a sequence having at least 95% sequence identity to SEQ ID NO: 53;
b) said sgRNA has at least 95% sequence identity to any one of SEQ ID NOs: 104-107, 144-146, 186-190, 245-247, 287-291, and 345-349, and wherein said RGN polypeptide has a sequence having at least 95% sequence identity to SEQ ID NO: 55;
c) said sgRNA has at least 95% sequence identity to any one of SEQ ID NOs: 108, 109, 195, 196, 301, and 302, and wherein said RGN polypeptide has a sequence having at least 95% sequence identity to SEQ ID NO: 52;
d) said sgRNA has at least 95% sequence identity to any one of SEQ ID NOs: 110, 111, 147, 148, 201, 248-250, 295-297, and 354-357, and wherein said RGN polypeptide has a sequence having at least 95% sequence identity to SEQ ID NO: 56;
e) said sgRNA has at least 95% sequence identity to any one of SEQ ID NOs: 112, 242-244, 362, and 564, and wherein said RGN polypeptide has a sequence having at least 95% sequence identity to SEQ ID NO: 42;
f) said sgRNA has at least 95% sequence identity to any one of SEQ ID NOs: 113, 149, 191-194, and 363, and wherein said RGN polypeptide has a sequence having at least 95% sequence identity to SEQ ID NO: 54;
g) said sgRNA has at least 95% sequence identity to any one of SEQ ID NOs: 114, 150, 202, 303, 358, and 359, and wherein said RGN polypeptide has a sequence having at least 95% sequence identity to SEQ ID NO: 57;
h) said sgRNA has at least 95% sequence identity to any one of SEQ ID NOs: 115, 151, 298-300, and 364, and wherein said RGN polypeptide has a sequence having at least 95% sequence identity to SEQ ID NO: 58; and
i) said sgRNA has at least 95% sequence identity to any one of SEQ ID NOs: 199, 200, 304, 360, and 361, and wherein said RGN polypeptide has a sequence having at least 95% sequence identity to SEQ ID NO: 59.

180. The system of embodiment 177, wherein:
a) said sgRNA has 100% sequence identity to any one of SEQ ID NOs: 98-104, 140-143, 197, 198, 235-241, 292-294, and 350-353, and wherein said RGN polypeptide has a sequence having 100% sequence identity to SEQ ID NO: 53;
b) said sgRNA has 100% sequence identity to any one of SEQ ID NOs: 104-107, 144-146, 186-190, 245-247, 287-291, and 345-349, and wherein said RGN polypeptide has a sequence having 100% sequence identity to SEQ ID NO: 55;
c) said sgRNA has 100% sequence identity to any one of SEQ ID NOs: 108, 109, 195, 196, 301, and 302, and wherein said RGN polypeptide has a sequence having 100% sequence identity to SEQ ID NO: 52;
d) said sgRNA has 100% sequence identity to any one of SEQ ID NOs: 110, 111, 147, 148, 201, 248-250, 295-297, and 354-357, and wherein said RGN polypeptide has a sequence having 100% sequence identity to SEQ ID NO: 56;
e) said sgRNA has 100% sequence identity to any one of SEQ ID NOs: 112, 242-244, 362, and 564, and wherein said RGN polypeptide has a sequence having 100% sequence identity to SEQ ID NO: 42;
f) said sgRNA has 100% sequence identity to any one of SEQ ID NOs: 113, 149, 191-194, and 363, and wherein said RGN polypeptide has a sequence having 100% sequence identity to SEQ ID NO: 54;
g) said sgRNA has 100% sequence identity to any one of SEQ ID NOs: 114, 150, 202, 303, 358, and 359, and wherein said RGN polypeptide has a sequence having 100% sequence identity to SEQ ID NO: 57;
h) said sgRNA has 100% sequence identity to any one of SEQ ID NOs: 115, 151, 298-300, and 364, and wherein said RGN polypeptide has a sequence having 100% sequence identity to SEQ ID NO: 58; and
i) said sgRNA has 100% sequence identity to any one of SEQ ID NOs: 199, 200, 304, 360, and 361, and wherein said RGN polypeptide has a sequence having 100% sequence identity to SEQ ID NO: 59.

181. A cell comprising the crRNA or nucleic acid molecule of embodiment 157, the guide RNA of any one of embodiments 158-163, the vector of embodiment 164 or the system of any one of embodiments 165-180.

182. A pharmaceutical composition comprising the crRNA or nucleic acid molecule of embodiment 157, the guide RNA of any one of embodiments 158-163, the vector of embodiment 164, the cell of embodiment 181, or the system of any one of embodiments 165-180, and a pharmaceutically acceptable carrier.

183. A composition comprising:
a) a fusion protein comprising a DNA-binding polypeptide and an adenine deaminase, or a nucleic acid molecule encoding the fusion protein; and
b) a second adenine deaminase having at least 90% sequence identity to any one of SEQ ID NOs: 407, 405, 399, 1-10, 400-404, 406, and 408-441; or a nucleic acid molecule encoding the deaminase.

184. The composition of embodiment 183, wherein said second adenine deaminase has at least 90% sequence identity to any one of SEQ ID NOs: 407, 405, 399, 1-10, 400-404, 406, and 408-441.

185. The composition of embodiment 183, wherein said second adenine deaminase has 100% sequence identity to any one of SEQ ID NOs: 407, 405, 399, 1-10, 400-404, 406, and 408-441.

186. The composition of any one of embodiments 183-185, wherein the first adenine deaminase has at least 90% sequence identity to any one of SEQ ID NOs: 407, 405, 399, 1-10, 400-404, 406, and 408-441.

187. The composition of any one of embodiments 183-186, wherein the first adenine deaminase has at least 95% sequence identity to any one of SEQ ID NOs: 407, 405, 399, 1-10, 400-404, 406, and 408-441.

188. The composition of any one of embodiments 183-186, wherein the first adenine deaminase has 100% sequence identity to any one of SEQ ID NOs: 407, 405, 399, 1-10, 400-404, 406, and 408-441.

189. The composition of any one of embodiments 183-188, wherein the DNA-binding polypeptide is a meganuclease, zinc finger fusion protein, or a TALEN.

190. The composition of any one of embodiments 183-189, wherein the DNA-binding polypeptide is an RNA-guided, DNA-binding polypeptide.

191. The composition of embodiment 190, wherein the RNA-guided, DNA-binding polypeptide is an RNA-guided nuclease (RGN) polypeptide.

192. The composition of embodiment 191, wherein the RGN is an RGN nickase.

193. A vector comprising a nucleic acid molecule encoding a fusion protein and a nucleic acid molecule encoding a second deaminase, wherein said fusion protein comprises a DNA-binding polypeptide and a first adenine deaminase, and wherein said second adenine deaminase has at least 90% sequence identity to any one of SEQ ID NOs: 407, 405, 399, 1-10, 400-404, 406, and 408-441.

194. The vector of embodiment 193, wherein said second adenine deaminase has at least 90% sequence identity to any one of SEQ ID NOs: 407, 405, 399, 1-10, 400-404, 406, and 408-441.

195. The vector of embodiment 193, wherein said second adenine deaminase has 100% sequence identity to any one of SEQ ID NOs: 407, 405, 399, 1-10, 400-404, 406, and 408-441.

196. The vector of any one of embodiments 193-195, wherein the first adenine deaminase has at least 90% sequence identity to any one of SEQ ID NOs: 407, 405, 399, 1-10, 400-404, 406, and 408-441.

197. The vector of any one of embodiments 193-195, wherein the first adenine deaminase has at least 95% sequence identity to any one of SEQ ID NOs: 407, 405, 399, 1-10, 400-404, 406, and 408-441.

198. The vector of any one of embodiments 193-195, wherein the first adenine deaminase has 100% sequence identity to any one of SEQ ID NOs: 407, 405, 399, 1-10, 400-404, 406, and 408-441.

199. The vector of any one of embodiments 193-198, wherein the DNA-binding polypeptide is a meganuclease, zinc finger fusion protein, or a TALEN.

200. The vector of any one of embodiments 193-198, wherein the DNA-binding polypeptide is an RNA-guided, DNA-binding polypeptide.

201. The vector of embodiment 200, wherein the RNA-guided, DNA-binding polypeptide is an RNA-guided nuclease (RGN) polypeptide.

202. The vector of embodiment 201, wherein the RGN is an RGN nickase.

203. A cell comprising the vector of any one of embodiments 193-202.

204. A cell comprising:
a) a fusion protein comprising a DNA-binding polypeptide and a first adenine deaminase; or a nucleic acid molecule encoding the fusion protein; and
b) a second adenine deaminase having at least 90% sequence identity to any one of SEQ ID NOs: 407, 405, 399, 1-10, 400-404, 406, and 408-441; or a nucleic acid molecule encoding the second adenine deaminase.

205. The cell of embodiment 204, wherein said second adenine deaminase has at least 90% sequence identity to any one of SEQ ID NOs: 407, 405, 399, 1-10, 400-404, 406, and 408-441.

206. The cell of embodiment 204, wherein said second adenine deaminase has 100% sequence identity to any one of SEQ ID NOs: 407, 405, 399, 1-10, 400-404, 406, and 408-441.

207. The cell of any one of embodiments 204-206, wherein the first adenine deaminase has at least 90% sequence identity to any one of SEQ ID NOs: 407, 405, 399, 1-10, 400-404, 406, and 408-441.

208. The cell of any one of embodiments 204-206, wherein the first adenine deaminase has at least 95% sequence identity to any one of SEQ ID NOs: 407, 405, 399, 1-10, 400-404, 406, and 408-441.

209. The cell of any one of embodiments 204-206, wherein the first adenine deaminase has 100% sequence identity to any one of SEQ ID NOs: 407, 405, 399, 1-10, 400-404, 406, and 408-441.

210. The cell of any one of embodiments 204-209, wherein the DNA-binding polypeptide is a meganuclease, zinc finger fusion protein, or a TALEN.

211. The cell of any one of embodiments 204-209, wherein the DNA-binding polypeptide is an RNA-guided, DNA-binding polypeptide.

212. The cell of embodiment 211, wherein the RNA-guided, DNA-binding polypeptide is an RNA-guided nuclease (RGN) polypeptide.

213. The cell of embodiment 212, wherein the RGN is an RGN nickase.

214. A pharmaceutical composition comprising a pharmaceutically acceptable carrier and the composition of any one of embodiments 183-192, the vector of any one of embodiments 193-202, or the cell of any one of embodiments 203-213.

215. A method for treating a disease, said method comprising administering to a subject in need thereof an effective amount of a pharmaceutical composition of any one of embodiments 69, 100, 142, and 214.

216. The method of embodiment 215, wherein said disease is associated with a causal mutation and said effective amount of said pharmaceutical composition corrects said causal mutation.

217. Use of the fusion protein of any one of embodiments 14-27, the nucleic acid molecule of any one of embodiments 28-48, the vector of any one of embodiments 49-52 and 193-202, the cell of any one of embodiments 59-63, 135-139, and 203-213, the system of any one of embodiments 75-99, or the composition of any one of embodiments 183-192 for the treatment of a disease in a subject.
218. The use of embodiment 217, wherein said disease is associated with a causal mutation and said treating comprises correcting said causal mutation.
219. Use of the fusion protein of any one of embodiments 14-27, the nucleic acid molecule of any one of embodiments 28-48, the vector of any one of embodiments 49-52 and 193-202, the cell of any one of embodiments 59-63, 135-139, and 203-213, the system of any one of embodiments 75-99, or the composition of any one of embodiments 183-192 for the manufacture of a medicament useful for treating a disease.
220. The use of embodiment 219, wherein said disease is associated with a causal mutation and an effective amount of said medicament corrects said causal mutation.
221. A nucleic acid molecule comprising a polynucleotide encoding an RNA-guided nuclease (RGN) polypeptide, wherein said polynucleotide comprises a nucleotide sequence encoding an RGN polypeptide comprising an amino acid sequence having at least 95% sequence identity to SEQ ID NO: 41 or 60, but lacking amino acid residues 590 to 597 of SEQ ID NO: 41 or 60; wherein said RGN polypeptide is capable of binding a target DNA sequence in an RNA-guided sequence specific manner when bound to a guide RNA (gRNA) capable of hybridizing to said target DNA sequence.
222. The nucleic acid molecule of embodiment 221, wherein said polynucleotide encoding an RGN polypeptide is operably linked to a promoter heterologous to said polynucleotide.
223. The nucleic acid molecule of embodiment 221 or 222, wherein said RGN polypeptide comprises an amino acid sequence having at least 95% sequence identity to SEQ ID NO: 366 or 368.
224. The nucleic acid molecule of embodiment 221 or 222, wherein said RGN polypeptide comprises an amino acid sequence of SEQ ID NO: 366 or 368.
225. The nucleic acid molecule of any one of embodiments 221-223, wherein said RGN polypeptide is nuclease dead or functions as a nickase.
226. The nucleic acid molecule of embodiment 225, wherein said nickase has the amino acid sequence set forth in SEQ ID NO: 397 or 398.
227. The nucleic acid molecule of any one of embodiments 221-226, wherein the RGN polypeptide is operably fused to a base-editing polypeptide.
228. A vector comprising the nucleic acid molecule of any one of claims 221-227.
229. An isolated polypeptide comprising an amino acid sequence having at least 95% sequence identity to SEQ ID NO: 41 or 60, but lacking amino acid residues 590 to 597 of SEQ ID NO: 41 or 60, wherein said polypeptide is an RNA-guided nuclease.
230. The isolated polypeptide of embodiment 229, wherein said RGN polypeptide comprises an amino acid sequence having at least 95% sequence identity to SEQ ID NO: 366 or 368.
231. The isolated polypeptide of embodiment 230, wherein said RGN polypeptide comprises an amino acid sequence of SEQ ID NO: 366 or 368.
232. The isolated polypeptide of embodiment 229 or 230, wherein said RGN polypeptide is nuclease dead or functions as a nickase.
233. The isolated polypeptide of embodiment 232, wherein said nickase has the amino acid sequence set forth in SEQ ID NO: 397 or 398.
234. The isolated polypeptide of any one of embodiments 229-233, wherein the RGN polypeptide is operably fused to a base-editing polypeptide.
235. A cell comprising the nucleic acid molecule of any one of embodiments 221-227, the vector of claim 228, or the polypeptide of any one of claims 229-234.
236. An isolated polypeptide comprising an amino acid sequence having at least 90% sequence identity to SEQ ID NO: 407, wherein said polypeptide has deaminase activity.
237. The isolated polypeptide of embodiment 236 comprising an amino acid sequence having at least 95% sequence identity to SEQ ID NO: 407, wherein said polypeptide has deaminase activity.
238. The isolated polypeptide of embodiment 236, wherein the polypeptide comprises an amino acid sequence set forth in SEQ ID NO: 407.
239. A nucleic acid molecule comprising a polynucleotide encoding a deaminase polypeptide, wherein the deaminase is encoded by a nucleotide sequence that:
a) has at least 80% sequence identity to SEQ ID NO: 451, or
b) encodes an amino acid sequence having at least 90% sequence identity to any one of SEQ ID NO: 407.
240. The nucleic acid molecule of embodiment 239, wherein the deaminase is encoded by a nucleotide sequence that has at least 90% sequence identity to SEQ ID NO: 451.
241. The nucleic acid molecule of embodiment 239, wherein the deaminase is encoded by a nucleotide sequence that has at least 95% sequence identity to SEQ ID NO: 451.
242. The nucleic acid molecule of embodiment 239, wherein the deaminase is encoded by a nucleotide sequence that has at least 100% sequence identity to SEQ ID NO: 451.
243. The nucleic acid molecule of embodiments 239-242, wherein said nucleic acid molecule further comprises a heterologous promoter operably linked to said polynucleotide.
244. A pharmaceutical composition comprising a pharmaceutically acceptable carrier and the polypeptide of any one of embodiments 236-238 or the nucleic acid molecule of any one of embodiments 239-242.
245. A fusion protein comprising a DNA-binding polypeptide and a deaminase having at least 90% sequence identity to SEQ ID NO: 407.
246. A fusion protein of embodiment 245 comprising a DNA-binding polypeptide and a deaminase having at least 95% sequence identity to SEQ ID NO: 407.
247. A fusion protein of embodiment 245 comprising a DNA-binding polypeptide and a deaminase having 100% sequence identity to SEQ ID NO: 407.
248. The fusion protein of any one of embodiments 245-247, wherein the DNA-binding polypeptide is a RNA-guided nuclease (RGN) polypeptide. 249. The fusion protein of embodiment 248, wherein the RGN polypeptide is a Type II CRISPR-Cas polypeptide or a Type V CRISPR-Cas polypeptide.
250. The fusion protein of any one of embodiments 248-249, wherein the RGN polypeptide is a Cas9, a CasX, a CasY, a Cpfl, a C2c1, a C2c2, a C2c3, a GeoCas9, a CjCas9, a Cas12a, a Cas12b, a Cas12g, a Cas12h, a Cas12i, a Cas13b, a Cas13c, a Cas13d, a Cas14, a Csn2, an xCas9, an SpCas9-NG, an LbCas12a, an AsCas12a, a Cas9-KKH, a circularly permuted Cas9, an Argonaute (Ago), a SmacCas9, a Spy-macCas9 domain, or a RGN polypeptide with an amino acid sequence set forth in any one of SEQ ID NOs: 41, 60, 366, or 368.
251. The fusion protein of any one of embodiments 248-250, wherein the RGN polypeptide is a nickase.
252. The fusion protein of embodiment 251, wherein the nickase has an amino acid sequence having at least 95% sequence identity to any one of SEQ ID NOs: 42, 52-59, 61, 397, and 398.
253. The fusion protein of embodiment 251, wherein the nickase has an amino acid sequence having 100% sequence identity to any one of SEQ ID NOs: 42, 52-59, 61, 397, and 398.
254. A nucleic acid molecule comprising a polynucleotide encoding a fusion protein comprising a DNA-binding polypeptide and a deaminase, wherein the deaminase is encoded by a nucleotide sequence that:
a) has at least 80% sequence identity to SEQ ID NO: 451, or
b) encodes an amino acid sequence having at least 90% sequence identity to SEQ ID NO: 407.
255. The nucleic acid molecule of embodiment 254, wherein the deaminase is encoded by a nucleotide sequence that has at least 90% sequence identity to SEQ ID NO: 451.
256. The nucleic acid molecule of embodiment 254, wherein the deaminase is encoded by a nucleotide sequence that has at least 95% sequence identity to SEQ ID NO: 451.
257. The nucleic acid molecule of embodiment 254, wherein the deaminase is encoded by a nucleotide sequence that has at least 100% sequence identity to SEQ ID NO: 451.
258. The nucleic acid molecule of any one of embodiments 254-257, wherein the DNA-binding polypeptide is a RGN polypeptide.
259. The nucleic acid molecule of embodiment 258, wherein the RGN is a Type II CRISPR-Cas polypeptide or a Type V CRISPR-Cas polypeptide.
260. The nucleic acid molecule of any one of embodiments 258-259, wherein the RGN polypeptide is a Cas9, a CasX, a CasY, a Cpfl, a C2c1, a C2c2, a C2c3, a GeoCas9, a CjCas9, a Cas12a, a Cas12b, a Cas12g, a Cas12h, a Cas12i, a Cas13b, a Cas13c, a Cas13d, a Cas14, a Csn2, an xCas9, an SpCas9-NG, an LbCas12a, an AsCas12a, a Cas9-KKH, a circularly permuted Cas9, an Argonaute (Ago), a SmacCas9, a Spy-macCas9 domain, or a RGN polypeptide with an amino acid sequence set forth in any one of SEQ ID NOs: 41, 60, 366, or 368.
261. The nucleic acid molecule of any one of embodiments 258-260, wherein the RGN polypeptide is a nickase.
262. The nucleic acid molecule of embodiment 261, wherein the nickase has an amino acid sequence having at least 95% sequence identity to any one of SEQ ID NOs: 42, 52-59, 61, 397, and 398.
263. The nucleic acid molecule of embodiment 262, wherein the nickase has an amino acid sequence having 100% sequence identity to any one of SEQ ID NOs: 42, 52-59, 61, 397, and 398.
264. A vector comprising the nucleic acid molecule of any one of embodiments 254-263.
265. The vector of embodiment 264, further comprising at least one nucleotide sequence encoding a guide RNA (gRNA) capable of hybridizing to a target sequence.
266. A ribonucleoprotein (RNP) complex comprising the fusion protein of any one of embodiments 245-253 and a guide RNA bound to the DNA-binding polypeptide of the fusion protein.
267. A cell comprising the fusion protein of any of embodiments 245-253, the nucleic acid molecule of any one of embodiments 254-263, the vector of any one of embodiments 264-265, or the RNP complex of embodiment 266.
268. A system for modifying a target DNA molecule comprising a target DNA sequence, said system comprising:
a) a fusion protein comprising an RNA-guided nuclease (RGN) polypeptide and a deaminase, wherein the deaminase has an amino acid sequence having at least 90% sequence identity to SEQ ID NO: 407, or a nucleotide sequence encoding said fusion protein; and
b) one or more guide RNAs capable of hybridizing to said target DNA sequence or one or more nucleotide sequences encoding the one or more guide RNAs (gRNAs); and
wherein the one or more guide RNAs are capable of forming a complex with the fusion protein in order to direct said fusion protein to bind to said target DNA sequence and modify the target DNA molecule.
269. The system of embodiment 268, wherein said deaminase has an amino acid sequence having at least 95% sequence identity to SEQ ID NO: 407.
270. The system of embodiment 268, wherein said deaminase has an amino acid sequence having 100% sequence identity to SEQ ID NO: 407.
271. The system of any one of embodiments 268-270, wherein at least one of said nucleotide sequence encoding the one or more guide RNAs and said nucleotide sequence encoding the fusion protein is operably linked to a promoter heterologous to said nucleotide sequence.
272. The system of any one of embodiments 268-271, wherein the target DNA sequence is located adjacent to a protospacer adjacent motif (PAM) that is recognized by the RGN polypeptide.
273. The system of any one of embodiments 268-272, wherein the target DNA sequence comprises a nucleic acid sequence selected from the group consisting of SEQ ID NOs: 62-97, 116-139, 152-185, 203-234, 251-286, 305-344, 562, and 563, or the complement thereof.
274. The system of any one of embodiments 268-273, wherein the gRNA sequence comprises a nucleic acid sequence selected from the group consisting of SEQ ID NOs: 98-115, 140-151, 186-202, 235-250, 287-304, 345-364, and 564.
275. The system of any one of embodiments 268-274, wherein the RGN polypeptide of the fusion protein is a Type II CRISPR-Cas polypeptide or a Type V CRISPR-Cas polypeptide.
276. The system of any one of embodiments 272-275, wherein the RGN polypeptide is a Cas9, a CasX, a CasY, a Cpfl, a C2c1, a C2c2, a C2c3, a GeoCas9, a CjCas9, a Cas12a, a Cas12b, a Cas12g, a Cas12h, a Cas12i, a Cas13b, a Cas13c, a Cas13d, a Cas14, a Csn2, an xCas9, an SpCas9-NG, an LbCas12a, an AsCas12a, a Cas9-KKH, a circularly permuted Cas9, an Argonaute (Ago), a SmacCas9, a Spy-macCas9 domain, or a RGN with an amino acid sequence set forth in any one of SEQ ID NOs: 41, 60, 366, or 368.

277. The system of embodiment 276, wherein the RGN polypeptide is a nickase.

278. The system of embodiment 277, wherein the nickase has an amino acid sequence having at least 95% sequence identity to any one of SEQ ID NOs: 42, 52-59, 61, 397, and 398.

279. A pharmaceutical composition comprising a pharmaceutically acceptable carrier and the fusion protein of any of embodiments 245-253, the nucleic acid molecule of any one of embodiments 254-263, the vector of any one of embodiments 264-265, the RNP complex of embodiment 266, the cell of embodiment 267, or the system of any one of embodiments 268-28.

280. A method for modifying a target DNA molecule comprising a target sequence comprising:
a) assembling an RGN-deaminase ribonucleotide complex by combining:
 i) one or more guide RNAs capable of hybridizing to the target DNA sequence; and
 ii) a fusion protein comprising an RNA-guided nuclease polypeptide (RGN), and at least one deaminase, wherein the deaminase has an amino acid sequence having at least 90% sequence identity to SEQ ID NO: 407;
under conditions suitable for formation of the RGN-deaminase ribonucleotide complex; and
b) contacting said target DNA molecule or a cell comprising said target DNA molecule with the assembled RGN-deaminase ribonucleotide complex;
wherein the one or more guide RNAs hybridize to the target DNA sequence, thereby directing said fusion protein to bind to said target DNA sequence and modification of the target DNA molecule occurs.

281. The method of embodiment 280, wherein the target DNA sequence comprises a nucleic acid sequence selected from the group consisting of SEQ ID NOs: 62-97, 116-139, 152-185, 203-234, 251-286, 305-344, 562, and 563, or the complement thereof.

282. The method of any one of embodiments 280-281, wherein the gRNA sequence comprises a nucleic acid sequence selected from the group consisting of SEQ ID NOs: 98-115, 140-151, 186-202, 235-250, 287-304, 345-364, and 564.

283. The method of any one of embodiments 280-283, wherein the method is performed in vitro, in vivo, or ex vivo.

284. A method of treating a subject having or at risk of developing a disease, disorder, or condition, the method comprising:
administering to the subject the fusion protein of any of embodiments 245-253, the nucleic acid molecule of any one of embodiments 254-263, the vector of any one of embodiments 264-265, the RNP complex of embodiment 266, the cell of embodiment 267, the system of any one of embodiments 268-28, or the pharmaceutical composition of embodiment 279.

285. The method of embodiment 284, further comprising administering any one of a gRNA comprising a nucleic acid sequence selected from the group consisting of SEQ ID NOs: 98-115, 140-151, 186-202, 235-250, 287-304, 345-364, and 564.

286. An isolated polypeptide comprising an amino acid sequence having at least 90% sequence identity to SEQ ID NO: 405, wherein said polypeptide has deaminase activity.

287. The isolated polypeptide of embodiment 286 comprising an amino acid sequence having at least 95% sequence identity to SEQ ID NO: 405, wherein said polypeptide has deaminase activity.

288. The isolated polypeptide of embodiment 286, wherein the polypeptide comprises an amino acid sequence set forth in SEQ ID NO: 407.

289. A nucleic acid molecule comprising a polynucleotide encoding a deaminase polypeptide, wherein the deaminase is encoded by a nucleotide sequence that:
a) has at least 80% sequence identity to SEQ ID NO: 449, or
b) encodes an amino acid sequence having at least 90% sequence identity to any one of SEQ ID NO: 405.

290. The nucleic acid molecule of embodiment 289, wherein the deaminase is encoded by a nucleotide sequence that has at least 90% sequence identity to SEQ ID NO: 449.

291. The nucleic acid molecule of embodiment 289, wherein the deaminase is encoded by a nucleotide sequence that has at least 95% sequence identity to SEQ ID NO: 449.

292. The nucleic acid molecule of embodiment 289, wherein the deaminase is encoded by a nucleotide sequence that has at least 100% sequence identity to SEQ ID NO: 449.

293. The nucleic acid molecule of embodiments 289-292, wherein said nucleic acid molecule further comprises a heterologous promoter operably linked to said polynucleotide.

294. A pharmaceutical composition comprising a pharmaceutically acceptable carrier and the polypeptide of any one of embodiments 286-288 or the nucleic acid molecule of any one of embodiments 289-293.

295. A fusion protein comprising a DNA-binding polypeptide and a deaminase having at least 90% sequence identity to SEQ ID NO: 405.

296. A fusion protein of embodiment 295 comprising a DNA-binding polypeptide and a deaminase having at least 95% sequence identity to SEQ ID NO: 405.

297. A fusion protein of embodiment 295 comprising a DNA-binding polypeptide and a deaminase having 100% sequence identity to SEQ ID NO: 405.

298. The fusion protein of any one of embodiments 295-297, wherein the DNA-binding polypeptide is a RNA-guided nuclease (RGN) polypeptide.

299. The fusion protein of embodiment 298, wherein the RGN polypeptide is a Type II CRISPR-Cas polypeptide or a Type V CRISPR-Cas polypeptide.

300. The fusion protein of any one of embodiments 298-299, wherein the RGN polypeptide is a Cas9, a CasX, a CasY, a Cpfl, a C2c1, a C2c2, a C2c3, a GeoCas9, a CjCas9, a Cas12a, a Cas12b, a Cas12g, a Cas12h, a Cas12i, a Cas13b, a Cas13c, a Cas13d, a Cas14, a Csn2, an xCas9, an SpCas9-NG, an LbCas12a, an AsCas12a, a Cas9-KKH, a circularly permuted Cas9, an Argonaute (Ago), a SmacCas9, a Spy-macCas9 domain, or a RGN polypeptide with an amino acid sequence set forth in any one of SEQ ID NOs: 41, 60, 366, or 368.

301. The fusion protein of any one of embodiments 298-300, wherein the RGN polypeptide is a nickase.

302. The fusion protein of embodiment 301, wherein the nickase has an amino acid sequence having at least 95% sequence identity to any one of SEQ ID NOs: 42, 52-59, 61, 397, and 398.

303. The fusion protein of embodiment 301, wherein the nickase has an amino acid sequence having 100% sequence identity to any one of SEQ ID NOs: 42, 52-59, 61, 397, and 398.

304. A nucleic acid molecule comprising a polynucleotide encoding a fusion protein comprising a DNA-binding polypeptide and a deaminase, wherein the deaminase is encoded by a nucleotide sequence that:
a) has at least 80% sequence identity to SEQ ID NO: 449, or
b) encodes an amino acid sequence having at least 90% sequence identity to SEQ ID NO: 405.

305. The nucleic acid molecule of embodiment 304, wherein the deaminase is encoded by a nucleotide sequence that has at least 90% sequence identity to SEQ ID NO: 449.

306. The nucleic acid molecule of embodiment 304, wherein the deaminase is encoded by a nucleotide sequence that has at least 95% sequence identity to SEQ ID NO: 449.

307. The nucleic acid molecule of embodiment 304, wherein the deaminase is encoded by a nucleotide sequence that has at least 100% sequence identity to SEQ ID NO: 449.

308. The nucleic acid molecule of any one of embodiments 304-307, wherein the DNA-binding polypeptide is a RGN polypeptide.

309. The nucleic acid molecule of embodiment 308, wherein the RGN is a Type II CRISPR-Cas polypeptide or a Type V CRISPR-Cas polypeptide.

310. The nucleic acid molecule of any one of embodiments 308-309, wherein the RGN polypeptide is a Cas9, a CasX, a CasY, a Cpf1, a C2c1, a C2c2, a C2c3, a GeoCas9, a CjCas9, a Cas12a, a Cas12b, a Cas12g, a Cas12h, a Cas12i, a Cas13b, a Cas13c, a Cas13d, a Cas14, a Csn2, an xCas9, an SpCas9-NG, an LbCas12a, an AsCas12a, a Cas9-KKH, a circularly permuted Cas9, an Argonaute (Ago), a SmacCas9, a Spy-macCas9 domain, or a RGN polypeptide with an amino acid sequence set forth in any one of SEQ ID NOs: 41, 60, 366, or 368.

311. The nucleic acid molecule of any one of embodiments 308-310, wherein the RGN polypeptide is a nickase.

312. The nucleic acid molecule of embodiment 311, wherein the nickase has an amino acid sequence having at least 95% sequence identity to any one of SEQ ID NOs: 42, 52-59, 61, 397, and 398.

313. The nucleic acid molecule of embodiment 312, wherein the nickase has an amino acid sequence having 100% sequence identity to any one of SEQ ID NOs: 42, 52-59, 61, 397, and 398.

314. A vector comprising the nucleic acid molecule of any one of embodiments 304-313.

315. The vector of embodiment 314, further comprising at least one nucleotide sequence encoding a guide RNA (gRNA) capable of hybridizing to a target sequence.

316. A ribonucleoprotein (RNP) complex comprising the fusion protein of any one of embodiments 295-303 and a guide RNA bound to the DNA-binding polypeptide of the fusion protein.

317. A cell comprising the fusion protein of any of embodiments 295-303, the nucleic acid molecule of any one of embodiments 304-313, the vector of any one of embodiments 314-315, or the RNP complex of embodiment 316.

318. A system for modifying a target DNA molecule comprising a target DNA sequence, said system comprising:
a) a fusion protein comprising an RNA-guided nuclease (RGN) polypeptide and a deaminase, wherein the deaminase has an amino acid sequence having at least 90% sequence identity to SEQ ID NO: 405, or a nucleotide sequence encoding said fusion protein; and
b) one or more guide RNAs capable of hybridizing to said target DNA sequence or one or more nucleotide sequences encoding the one or more guide RNAs (gRNAs); and
wherein the one or more guide RNAs are capable of forming a complex with the fusion protein in order to direct said fusion protein to bind to said target DNA sequence and modify the target DNA molecule.

319. The system of embodiment 318, wherein said deaminase has an amino acid sequence having at least 95% sequence identity to SEQ ID NO: 405.

320. The system of embodiment 318, wherein said deaminase has an amino acid sequence having 100% sequence identity to SEQ ID NO: 405.

321. The system of any one of embodiments 318-320, wherein at least one of said nucleotide sequence encoding the one or more guide RNAs and said nucleotide sequence encoding the fusion protein is operably linked to a promoter heterologous to said nucleotide sequence.

322. The system of any one of embodiments 318-321, wherein the target DNA sequence is located adjacent to a protospacer adjacent motif (PAM) that is recognized by the RGN polypeptide.

323. The system of any one of embodiments 318-322, wherein the target DNA sequence comprises a nucleic acid sequence selected from the group consisting of SEQ ID NOs: 62-97, 116-139, 152-185, 203-234, 251-286, 305-344, 562, and 563, or the complement thereof.

324. The system of any one of embodiments 318-323, wherein the gRNA sequence comprises a nucleic acid sequence selected from the group consisting of SEQ ID NOs: 98-115, 140-151, 186-202, 235-250, 287-304, 345-364, and 564.

325. The system of any one of embodiments 318-324, wherein the RGN polypeptide of the fusion protein is a Type II CRISPR-Cas polypeptide or a Type V CRISPR-Cas polypeptide.

326. The system of any one of embodiments 322-325, wherein the RGN polypeptide is a Cas9, a CasX, a CasY, a Cpf1, a C2c1, a C2c2, a C2c3, a GeoCas9, a CjCas9, a Cas12a, a Cas12b, a Cas12g, a Cas12h, a Cas12i, a Cas13b, a Cas13c, a Cas13d, a Cas14, a Csn2, an xCas9, an SpCas9-NG, an LbCas12a, an AsCas12a, a Cas9-KKH, a circularly permuted Cas9, an Argonaute (Ago), a SmacCas9, a Spy-macCas9 domain, or a RGN with an amino acid sequence set forth in any one of SEQ ID NOs: 41, 60, 366, or 368.

327. The system of embodiment 326, wherein the RGN polypeptide is a nickase.

328. The system of embodiment 327, wherein the nickase has an amino acid sequence having at least 95% sequence identity to any one of SEQ ID NOs: 42, 52-59, 61, 397, and 398.

329. A pharmaceutical composition comprising a pharmaceutically acceptable carrier and the fusion protein of any of embodiments 295-303, the nucleic acid molecule of any one of embodiments 304-313, the vector of any one of embodiments 314-315, the RNP complex of embodiment 316, the cell of embodiment 317, or the system of any one of embodiments 318-328.

330. A method for modifying a target DNA molecule comprising a target sequence comprising:
a) assembling an RGN-deaminase ribonucleotide complex by combining:
i) one or more guide RNAs capable of hybridizing to the target DNA sequence; and
ii) a fusion protein comprising an RNA-guided nuclease polypeptide (RGN), and at least one deaminase, wherein the deaminase has an amino acid sequence having at least 90% sequence identity to SEQ ID NO: 405;
under conditions suitable for formation of the RGN-deaminase ribonucleotide complex; and
b) contacting said target DNA molecule or a cell comprising said target DNA molecule with the assembled RGN-deaminase ribonucleotide complex;
wherein the one or more guide RNAs hybridize to the target DNA sequence, thereby directing said fusion protein to bind to said target DNA sequence and modification of the target DNA molecule occurs.

331. The method of embodiment 330, wherein the target DNA sequence comprises a nucleic acid sequence selected from the group consisting of SEQ ID NOs: 62-97, 116-139, 152-185, 203-234, 251-286, 305-344, 562, and 563, or the complement thereof.

332. The method of any one of embodiments 330-331, wherein the gRNA sequence comprises a nucleic acid sequence selected from the group consisting of SEQ ID NOs: 98-115, 140-151, 186-202, 235-250, 287-304, 345-364, and 564.

333. The method of any one of embodiments 330-332, wherein the method is performed in vitro, in vivo, or ex vivo.

334. A method of treating a subject having or at risk of developing a disease, disorder, or condition, the method comprising:
administering to the subject the fusion protein of any of embodiments 295-303, the nucleic acid molecule of any one of embodiments 304-313, the vector of any one of embodiments 314-315, the RNP complex of embodiment 316, the cell of embodiment 317, the system of any one of embodiments 318-328, or the pharmaceutical composition of embodiment 329.

335. The method of embodiment 334, further comprising administering any one of a gRNA comprising a nucleic acid sequence selected from the group consisting of SEQ ID NOs: 98-115, 140-151, 186-202, 235-250, 287-304, 345-364, and 564.

336. An isolated polypeptide comprising an amino acid sequence having at least 90% sequence identity to SEQ ID NO: 399, wherein said polypeptide has deaminase activity.

337. The isolated polypeptide of embodiment 336 comprising an amino acid sequence having at least 95% sequence identity to SEQ ID NO: 399, wherein said polypeptide has deaminase activity.

338. The isolated polypeptide of embodiment 336, wherein the polypeptide comprises an amino acid sequence set forth in SEQ ID NO: 399.

339. A nucleic acid molecule comprising a polynucleotide encoding a deaminase polypeptide, wherein the deaminase is encoded by a nucleotide sequence that:
a) has at least 80% sequence identity to SEQ ID NO: 443, or
b) encodes an amino acid sequence having at least 90% sequence identity to any one of SEQ ID NO: 399.

340. The nucleic acid molecule of embodiment 339, wherein the deaminase is encoded by a nucleotide sequence that has at least 90% sequence identity to SEQ ID NO: 443.

341. The nucleic acid molecule of embodiment 339, wherein the deaminase is encoded by a nucleotide sequence that has at least 95% sequence identity to SEQ ID NO: 443.

342. The nucleic acid molecule of embodiment 339, wherein the deaminase is encoded by a nucleotide sequence that has at least 100% sequence identity to SEQ ID NO: 443.

343. The nucleic acid molecule of embodiments 339-342, wherein said nucleic acid molecule further comprises a heterologous promoter operably linked to said polynucleotide.

344. A pharmaceutical composition comprising a pharmaceutically acceptable carrier and the polypeptide of any one of embodiments 336-338 or the nucleic acid molecule of any one of embodiments 339-342.

345. A fusion protein comprising a DNA-binding polypeptide and a deaminase having at least 90% sequence identity to SEQ ID NO: 399.

346. A fusion protein of embodiment 345 comprising a DNA-binding polypeptide and a deaminase having at least 95% sequence identity to SEQ ID NO: 399.

347. A fusion protein of embodiment 345 comprising a DNA-binding polypeptide and a deaminase having 100% sequence identity to SEQ ID NO: 399.

348. The fusion protein of any one of embodiments 345-347, wherein the DNA-binding polypeptide is a RNA-guided nuclease (RGN) polypeptide.

349. The fusion protein of embodiment 348, wherein the RGN polypeptide is a Type II CRISPR-Cas polypeptide or a Type V CRISPR-Cas polypeptide.

350. The fusion protein of any one of embodiments 348-349, wherein the RGN polypeptide is a Cas9, a CasX, a CasY, a Cpf1, a C2c1, a C2c2, a C2c3, a GeoCas9, a CjCas9, a Cas12a, a Cas12b, a Cas12g, a Cas12h, a Cas12i, a Cas13b, a Cas13c, a Cas13d, a Cas14, a Csn2, an xCas9, an SpCas9-NG, an LbCas12a, an AsCas12a, a Cas9-KKH, a circularly permuted Cas9, an Argonaute (Ago), a SmacCas9, a Spy-macCas9 domain, or a RGN polypeptide with an amino acid sequence set forth in any one of SEQ ID NOs: 41, 60, 366, or 368.

351. The fusion protein of any one of embodiments 348-350, wherein the RGN polypeptide is a nickase.

352. The fusion protein of embodiment 351, wherein the nickase has an amino acid sequence having at least 95% sequence identity to any one of SEQ ID NOs: 42, 52-59, 61, 397, and 398.

353. The fusion protein of embodiment 351, wherein the nickase has an amino acid sequence having 100% sequence identity to any one of SEQ ID NOs: 42, 52-59, 61, 397, and 398.

354. A nucleic acid molecule comprising a polynucleotide encoding a fusion protein comprising a DNA-binding polypeptide and a deaminase, wherein the deaminase is encoded by a nucleotide sequence that:
a) has at least 80% sequence identity to SEQ ID NO: 443, or
b) encodes an amino acid sequence having at least 90% sequence identity to SEQ ID NO: 399.

355. The nucleic acid molecule of embodiment 354, wherein the deaminase is encoded by a nucleotide sequence that has at least 90% sequence identity to SEQ ID NO: 443.

356. The nucleic acid molecule of embodiment 354, wherein the deaminase is encoded by a nucleotide sequence that has at least 95% sequence identity to SEQ ID NO: 443.

357. The nucleic acid molecule of embodiment 354, wherein the deaminase is encoded by a nucleotide sequence that has at least 100% sequence identity to SEQ ID NO: 443.

358. The nucleic acid molecule of any one of embodiments 354-357, wherein the DNA-binding polypeptide is a RGN polypeptide.

359. The nucleic acid molecule of embodiment 358, wherein the RGN is a Type II CRISPR-Cas polypeptide or a Type V CRISPR-Cas polypeptide.

360. The nucleic acid molecule of any one of embodiments 358-359, wherein the RGN polypeptide is a Cas9, a CasX, a CasY, a Cpf1, a C2c1, a C2c2, a C2c3, a GeoCas9, a CjCas9, a Cas12a, a Cas12b, a Cas12g, a Cas12h, a Cas12i, a Cas13b, a Cas13c, a Cas13d, a Cas14, a Csn2, an xCas9, an SpCas9-NG, an LbCas12a, an AsCas12a, a Cas9-KKH, a circularly permuted Cas9, an Argonaute (Ago), a SmacCas9, a Spy-macCas9 domain, or a RGN polypeptide with an amino acid sequence set forth in any one of SEQ ID NOs: 41, 60, 366, or 368.

361. The nucleic acid molecule of any one of embodiments 358-360, wherein the RGN polypeptide is a nickase.

362. The nucleic acid molecule of embodiment 361, wherein the nickase has an amino acid sequence having at least 95% sequence identity to any one of SEQ ID NOs: 42, 52-59, 61, 397, and 398.

363. The nucleic acid molecule of embodiment 362, wherein the nickase has an amino acid sequence having 100% sequence identity to any one of SEQ ID NOs: 42, 52-59, 61, 397, and 398.

364. A vector comprising the nucleic acid molecule of any one of embodiments 354-363.

365. The vector of embodiment 364, further comprising at least one nucleotide sequence encoding a guide RNA (gRNA) capable of hybridizing to a target sequence.

366. A ribonucleoprotein (RNP) complex comprising the fusion protein of any one of embodiments 345-353 and a guide RNA bound to the DNA-binding polypeptide of the fusion protein.

367. A cell comprising the fusion protein of any of embodiments 345-353, the nucleic acid molecule of any one of embodiments 354-363, the vector of any one of embodiments 364-365, or the RNP complex of embodiment 366.

368. A system for modifying a target DNA molecule comprising a target DNA sequence, said system comprising:
a) a fusion protein comprising an RNA-guided nuclease (RGN) polypeptide and a deaminase, wherein the deaminase has an amino acid sequence having at least 90% sequence identity to SEQ ID NO: 399, or a nucleotide sequence encoding said fusion protein; and
b) one or more guide RNAs capable of hybridizing to said target DNA sequence or one or more nucleotide sequences encoding the one or more guide RNAs (gRNAs); and wherein the one or more guide RNAs are capable of forming a complex with the fusion protein in order to direct said fusion protein to bind to said target DNA sequence and modify the target DNA molecule.

369. The system of embodiment 368, wherein said deaminase has an amino acid sequence having at least 95% sequence identity to SEQ ID NO: 399.

370. The system of embodiment 368, wherein said deaminase has an amino acid sequence having 100% sequence identity to SEQ ID NO: 399.

371. The system of any one of embodiments 368-370, wherein at least one of said nucleotide sequence encoding the one or more guide RNAs and said nucleotide sequence encoding the fusion protein is operably linked to a promoter heterologous to said nucleotide sequence.

372. The system of any one of embodiments 368-371, wherein the target DNA sequence is located adjacent to a protospacer adjacent motif (PAM) that is recognized by the RGN polypeptide.

373. The system of any one of embodiments 368-372, wherein the target DNA sequence comprises a nucleic acid sequence selected from the group consisting of SEQ ID NOs: 62-97, 116-139, 152-185, 203-234, 251-286, 305-344, 562, and 563, or the complement thereof.

374. The system of any one of embodiments 368-373, wherein the gRNA sequence comprises a nucleic acid sequence selected from the group consisting of SEQ ID NOs: 98-115, 140-151, 186-202, 235-250, 287-304, 345-364, and 564.

375. The system of any one of embodiments 368-374, wherein the RGN polypeptide of the fusion protein is a Type II CRISPR-Cas polypeptide or a Type V CRISPR-Cas polypeptide.

376. The system of any one of embodiments 372-375, wherein the RGN polypeptide is a Cas9, a CasX, a CasY, a Cpf1, a C2c1, a C2c2, a C2c3, a GeoCas9, a CjCas9, a Cas12a, a Cas12b, a Cas12g, a Cas12h, a Cas12i, a Cas13b, a Cas13c, a Cas13d, a Cas14, a Csn2, an xCas9, an SpCas9-NG, an LbCas12a, an AsCas12a, a Cas9-KKH, a circularly permuted Cas9, an Argonaute (Ago), a SmacCas9, a Spy-macCas9 domain, or a RGN with an amino acid sequence set forth in any one of SEQ ID NOs: 41, 60, 366, or 368.

377. The system of embodiment 376, wherein the RGN polypeptide is a nickase.

378. The system of embodiment 377, wherein the nickase has an amino acid sequence having at least 95% sequence identity to any one of SEQ ID NOs: 42, 52-59, 61, 397, and 398.

379. A pharmaceutical composition comprising a pharmaceutically acceptable carrier and the fusion protein of any of embodiments 345-353, the nucleic acid molecule of any one of embodiments 354-363, the vector of any one of embodiments 364-365, the RNP complex of embodiment 366, the cell of embodiment 367, or the system of any one of embodiments 368-378.

380. A method for modifying a target DNA molecule comprising a target sequence comprising:
a) assembling an RGN-deaminase ribonucleotide complex by combining:
i) one or more guide RNAs capable of hybridizing to the target DNA sequence; and
ii) a fusion protein comprising an RNA-guided nuclease polypeptide (RGN), and at least one deaminase, wherein the deaminase has an amino acid sequence having at least 90% sequence identity to SEQ ID NO: 399;

under conditions suitable for formation of the RGN-deaminase ribonucleotide complex; and b) contacting said target DNA molecule or a cell comprising said target DNA molecule with the assembled RGN-deaminase ribonucleotide complex;

wherein the one or more guide RNAs hybridize to the target DNA sequence, thereby directing said fusion protein to bind to said target DNA sequence and modification of the target DNA molecule occurs.

381. The method of embodiment 380, wherein the target DNA sequence comprises a nucleic acid sequence selected from the group consisting of SEQ ID NOs: 62-97, 116-139, 152-185, 203-234, 251-286, 305-344, 562, and 563, or the complement thereof.

382. The method of any one of embodiments 380-381, wherein the gRNA sequence comprises a nucleic acid sequence selected from the group consisting of SEQ ID NOs: 98-115, 140-151, 186-202, 235-250, 287-304, 345-364, and 564.

383. The method of any one of embodiments 380-382, wherein the method is performed in vitro, in vivo, or ex vivo.

384. A method of treating a subject having or at risk of developing a disease, disorder, or condition, the method comprising:
administering to the subject the fusion protein of any of embodiments 345-353, the nucleic acid molecule of any one of embodiments 354-363, the vector of any one of embodiments 364-365, the RNP complex of embodiment 366, the cell of embodiment 367, the system of any one of embodiments 368-378, or the pharmaceutical composition of embodiment 379.

385. The method of embodiment 384, further comprising administering any one of a gRNA comprising a nucleic acid sequence selected from the group consisting of SEQ ID NOs: 98-115, 140-151, 186-202, 235-250, 287-304, 345-364, and 564.

386. A method for producing a treating or reducing at least one symptom of cystic fibrosis, the method comprising administering to a subject in need thereof an effective amount of:
a) a fusion protein comprising an RNA-guided nuclease polypeptide (RGN) and a deaminase, wherein the deaminase has an amino acid sequence having at least 90% sequence identity to any one of SEQ ID NOs: 407, 405, 399, 1-10, 400-404, 406, and 408-441, or a polynucleotide encoding said fusion protein, wherein said polynucleotide encoding the fusion protein is operably linked to a promoter to enable expression of the fusion protein in the cell; and
b) one or more guide RNAs (gRNA) capable of hybridizing to a target DNA sequence, or a polynucleotide encoding said gRNA, wherein said polynucleotide encoding the gRNA is operably linked to a promoter to enable expression of the gRNA in the cell; whereby the fusion protein and gRNA target to the genomic location of the causal mutation and modify the genomic sequence to remove the causal mutation.

387. The method of embodiment 386, wherein the gRNA comprises a spacer sequence that targets any one of SEQ ID NOs: 62-97, 116-139, 152-185, 203-234, 251-286, 305-344, 562, and 563, or the complement thereof.

388. The method of embodiments 386 or 387, wherein the gRNA comprises any one of SEQ ID NOs: 98-115, 140-151, 186-202, 235-250, 287-304, 345-364, and 564.

389. The method of any one of claims 386-388, wherein said the RGN has an amino acid sequence having at least 90% sequence identity to any one of SEQ ID NOs: 41, 60, 366, and 368.

390. The method of any one of claims 386-389, wherein said the RGN has an amino acid sequence having at least 90% sequence identity to any one of SEQ ID NOs: 42, 52-59, 61, 397, and 398.

The following examples are offered by way of illustration and not by way of limitation.

EXPERIMENTAL

Example 1: Demonstration of Base Editing in Mammalian Cells

The deaminases shown in Table 1 below were produced based on naturally occurring deaminases which were then mutated and selected for adenine deaminase activity in prokaryotic cells.

TABLE 1

Deaminase sequences

| Deaminase | SEQ ID NO. |
|---|---|
| APG09982 | 1 |
| APG03724 | 2 |
| APG09949 | 3 |
| APG08196 | 4 |
| APG06333 | 5 |
| APG06489 | 6 |
| APG08449 | 7 |
| APG05174 | 8 |
| APG09102 | 9 |
| APG05723 | 10 |

To determine if the deaminases of Table 1 are able to perform adenine base editing in mammalian cells, each deaminase was operably fused to an RGN nickase to produce a fusion protein. Residues predicted to deactivate the RuvC domain of the RGN APG07433.1 (set forth as SEQ ID NO: 41; described in PCT publication WO 2019/236566, incorporated by reference herein) were identified and the RGN was modified to a nickase variant (nAPG07433.1; SEQ ID NO: 42). A nickase variant of an RGN is referred to herein as "nRGN". It should be understood that any nickase variant of an RGN may be used to produce a fusion protein of the invention.

Deaminase and nRGN nucleotide sequences codon optimized for mammalian expression were synthesized as fusion proteins with an N-terminal nuclear localization tag and cloned into the pTwist CMV (Twist Biosciences) expression plasmid. Each fusion protein comprises, starting at the amino terminus, the SV40 NLS (SEQ ID NO: 43) operably linked at the C-terminal end to 3xFLAG Tag (SEQ ID NO: 44), operably linked at the C-terminal end to a deaminase, operably linked at the C-terminal end to a peptide linker (SEQ ID NO: 45), operably linked at the C-terminal end to an nRGN (for example, nAPG07433.1, which is SEQ ID NO: 42), finally operably linked at the C-terminal end to the nucleoplasmin NLS (SEQ ID NO: 45). All fusion proteins comprise at least one NLS and a 3xFLAG Tag, as described above.

Expression plasmids comprising an expression cassette encoding a sgRNA expressed by a human U6 promoter (SEQ ID NO: 50) were also produced. Human genomic target sequences and the sgRNA sequences for guiding the fusion proteins to the genomic targets are indicated in Table 2.

TABLE 2

Guide RNA sequences

| sgRNA ID | Target sequence | sgRNA sequence | Forward Primer for amplification | Reverse Primer for amplification |
|---|---|---|---|---|
| SGN000930 | 21 | 26 | 31 | 32 |
| SGN000186 | 22 | 27 | 33 | 34 |
| SGN000194 | 23 | 28 | 35 | 36 |
| SGN000143 | 24 | 29 | 37 | 38 |
| SGN000139 | 25 | 30 | 39 | 40 |

500 ng of plasmid comprising an expression cassette comprising a coding sequence for a fusion protein for each deaminase described in Table 1 and 500 ng of plasmid comprising an expression cassette encoding an sgRNA shown in Table 2 were co-transfected into HEK293FT cells at 75-90% confluency in 24-well plates using Lipofectamine 2000 reagent (Life Technologies). Cells were then incubated at 37° C. for 72 h. Following incubation, genomic DNA was then extracted using NucleoSpin 96 Tissue (Macherey-Nagel) following the manufacturer's protocol. The genomic region flanking the targeted genomic site was PCR amplified using the primers in Table 2 and products were purified using ZR-96 DNA Clean and Concentrator (Zymo Research) following the manufacturer's protocol. The purified PCR products underwent Next Generation Sequencing on Illumina MiSeq. Typically, 100,000 of 250 bp paired-end reads (2×100,000 reads) are generated per amplicon. The reads were analyzed using CRISPResso (Pinello, et al. 2016 Nature Biotech, 34:695-697) to calculate the rates of editing. Output alignments were analyzed for INDEL formation or introduction of specific adenine mutations. Tables 3 through 7 show adenine base editing for each fusion protein comprising nAPG07433.1 and a deaminase from Table 1 and a guide RNA from Table 2. The deaminase component of each fusion protein is indicated. The editing rate for adenines within or proximal to the target sequence is indicated. "A5" indicates, for example, an adenine at position 5 of the target sequence. The position of each nucleotide in the target sequence was determined by numbering the first nucleotide in the target sequence closest to the PAM as position 1, and the position number increases in the 3' direction away from the PAM sequence. The tables also show which nucleotide the adenine was changed to, and at what rate. For example, Table 3 shows that for the APG09982-nAPG07433.1 fusion protein, the adenine at position 13 was mutated to a guanine at a rate of 1.2%.

TABLE 3

A > N Editing Rate using guide SGN000139

| Deaminase | | A5 | A12 | A13 | A20 | A22 |
|---|---|---|---|---|---|---|
| APG09982 | C | 0 | 0 | 0 | 0.3 | 0 |
| | G | 0 | 0.5 | 1.2 | 0 | 0 |
| | T | 0 | 0 | 0 | 0 | 0 |
| APG03724 | C | 0 | 0 | 0 | 0.3 | 0 |
| | G | 0 | 0.7 | 0.7 | 0.1 | 0 |
| | T | 0 | 0 | 0 | 0 | 0 |
| APG09949 | C | 0 | 0 | 0 | 0.3 | 0.1 |
| | G | 0.1 | 0.6 | 0.7 | 0 | 0 |
| | T | 0 | 0 | 0 | 0 | 0 |
| APG08196 | C | 0 | 0 | 0 | 0.6 | 0.1 |
| | G | 0 | 0.6 | 0.6 | 0 | 0 |
| | T | 0 | 0 | 0 | 0 | 0 |
| APG06333 | C | 0 | 0 | 0 | 0.2 | 0 |
| | G | 0 | 0.5 | 1 | 0 | 0 |
| | T | 0 | 0 | 0 | 0 | 0 |
| APG06489 | C | 0 | 0 | 0 | 0.2 | 0 |
| | G | 0 | 0.6 | 0.4 | 0 | 0 |
| | T | 0 | 0 | 0 | 0 | 0 |
| APG08449 | C | 0 | 0 | 0 | 0.3 | 0.1 |
| | G | 0 | 0.8 | 0.8 | 0 | 0 |
| | T | 0 | 0 | 0 | 0 | 0 |
| APG05174 | C | 0 | 0 | 0 | 0.6 | 0.1 |
| | G | 0 | 0.6 | 0.7 | 0 | 0 |
| | T | 0 | 0 | 0 | 0 | 0 |
| APG09102 | C | 0 | 0 | 0 | 0.1 | 0 |
| | G | 0 | 0.6 | 0.6 | 0 | 0 |
| | T | 0 | 0 | 0 | 0 | 0 |
| APG05723 | C | 0 | 0 | 0 | 0.1 | 0 |
| | G | 0 | 0.4 | 0.5 | 0.1 | 0 |
| | T | 0 | 0 | 0 | 0 | 0 |

All fusion proteins showed detectable A>G conversion at positions A12 and A13. APG09982 and APG06333 showed at least 1% editing at position A13.

TABLE 4

A > N Editing Rate using guide SGN000143

| Deaminase | | A1 | A4 | A6 | A9 | A11 | A14 | A19 | A30 |
|---|---|---|---|---|---|---|---|---|---|
| APG09982 | C | 0 | 0 | 0 | 0 | 0 | 0 | 0 | 0 |
| | G | 0 | 0 | 0 | 0.1 | 4.5 | 1.7 | 0 | 0 |
| | T | 0 | 0 | 0 | 0 | 0 | 0 | 0 | 0 |
| APG03724 | C | 0 | 0 | 0 | 0 | 0 | 0 | 0 | 0 |
| | G | 0 | 0 | 0.1 | 0.1 | 1.3 | 1.1 | 0 | 0 |
| | T | 0 | 0 | 0 | 0 | 0 | 0 | 0 | 0 |
| APG09949 | C | 0 | 0 | 0 | 0 | 0 | 0 | 0 | 0.1 |
| | G | 0 | 0 | 0 | 0.1 | 0.8 | 0.7 | 0 | 0 |
| | T | 0 | 0 | 0 | 0 | 0 | 0 | 0 | 0 |
| APG08196 | C | 0 | 0 | 0 | 0 | 0 | 0 | 0 | 0 |
| | G | 0 | 0 | 0 | 0.4 | 0.7 | 0.5 | 0.1 | 0 |
| | T | 0 | 0 | 0 | 0 | 0 | 0 | 0 | 0 |
| APG06333 | C | 0 | 0 | 0 | 0 | 0 | 0 | 0 | 0 |
| | G | 0 | 0 | 0 | 0 | 1.3 | 0.8 | 0.1 | 0 |
| | T | 0 | 0 | 0 | 0 | 0 | 0 | 0 | 0 |
| APG06489 | C | 0 | 0 | 0 | 0 | 0 | 0 | 0 | 0 |
| | G | 0 | 0 | 0.1 | 0.6 | 1.8 | 0.8 | 0.1 | 0 |
| | T | 0 | 0 | 0 | 0 | 0 | 0 | 0 | 0 |
| APG08449 | C | 0 | 0 | 0 | 0 | 0 | 0 | 0 | 0.1 |
| | G | 0 | 0 | 0 | 0 | 2.4 | 1.2 | 0 | 0 |
| | T | 0 | 0 | 0 | 0 | 0 | 0 | 0 | 0 |
| APG05174 | C | 0 | 0 | 0 | 0 | 0 | 0 | 0 | 0 |
| | G | 0 | 0 | 0 | 0 | 1.5 | 0.7 | 0 | 0 |
| | T | 0 | 0 | 0 | 0 | 0 | 0 | 0 | 0 |
| APG09102 | C | 0 | 0 | 0 | 0 | 0 | 0 | 0 | 0 |
| | G | 0 | 0 | 0 | 0 | 2.6 | 1.6 | 0 | 0 |
| | T | 0 | 0 | 0 | 0 | 0 | 0 | 0 | 0 |
| APG05723 | C | 0 | 0 | 0 | 0 | 0.1 | 0 | 0 | 0 |
| | G | 0 | 0 | 0.1 | 0.1 | 1.1 | 0.5 | 0 | 0 |
| | T | 0 | 0 | 0 | 0 | 0 | 0 | 0 | 0 |

All fusion proteins showed A>G conversion at positions A11 and A14. APG09982 showed 4.5% conversion of A11 to G and 1.7% conversion of A14 to G.

TABLE 5

A > N Editing Rate using guide SGN000186

| Deaminase | | A9 | A16 | A18 | A22 | A25 | A28 | A30 |
|---|---|---|---|---|---|---|---|---|
| APG09982 | C | 0 | 0 | 0 | 0 | 0 | 0 | 0 |
| | G | 1.7 | 4.5 | 2 | 0 | 0 | 0 | 0 |
| | T | 0 | 0 | 0 | 0 | 0 | 0 | 0 |
| APG03724 | C | 0 | 0 | 0 | 0 | 0.1 | 0 | 0 |
| | G | 0.7 | 4.1 | 1.4 | 0 | 0 | 0 | 0 |
| | T | 0 | 0 | 0 | 0 | 0 | 0 | 0 |
| APG09949 | C | 0 | 0 | 0.1 | 0 | 0.1 | 0 | 0 |
| | G | 0.6 | 3.4 | 1.1 | 0 | 0 | 0 | 0 |
| | T | 0 | 0 | 0 | 0 | 0.1 | 0 | 0 |
| APG08196 | C | 0 | 0 | 0.1 | 0 | 0.1 | 0 | 0 |
| | G | 1 | 3.3 | 1.4 | 0 | 0 | 0.1 | 0 |
| | T | 0 | 0 | 0 | 0 | 0.1 | 0 | 0 |
| APG06333 | C | 0 | 0 | 0 | 0 | 0 | 0 | 0 |
| | G | 1.4 | 4.2 | 1.9 | 0 | 0 | 0 | 0 |
| | T | 0 | 0 | 0 | 0 | 0 | 0 | 0 |
| APG06489 | C | 0 | 0 | 0 | 0 | 0 | 0 | 0 |
| | G | 1.7 | 2.5 | 1.4 | 0 | 0 | 0 | 0.1 |
| | T | 0 | 0 | 0 | 0 | 0 | 0 | 0 |
| APG08449 | C | 0 | 0 | 0.1 | 0 | 0.1 | 0 | 0 |
| | G | 1.5 | 5.3 | 1.6 | 0 | 0 | 0 | 0 |
| | T | 0 | 0 | 0 | 0 | 0.1 | 0 | 0 |
| APG05174 | C | 0 | 0 | 0.1 | 0 | 0 | 0 | 0 |
| | G | 0.9 | 3.2 | 1 | 0 | 0 | 0.1 | 0 |
| | T | 0 | 0 | 0 | 0 | 0.1 | 0 | 0 |
| APG09102 | C | 0 | 0 | 0 | 0 | 0 | 0 | 0 |
| | G | 2.3 | 6.2 | 2.1 | 0 | 0 | 0 | 0 |
| | T | 0 | 0 | 0 | 0 | 0 | 0 | 0 |
| APG05723 | C | 0 | 0 | 0 | 0 | 0 | 0 | 0 |
| | G | 1.1 | 1.9 | 1.2 | 0 | 0 | 0 | 0 |
| | T | 0 | 0 | 0 | 0 | 0 | 0 | 0 |

All fusion proteins showed base editing of over 1% at multiple locations in target SGN000186. APG09102 showed 6.2% A>G conversion at position A16; it also showed over 2% base editing at positions A9 and A18. For all fusion proteins tested, position A16 was the most highly edited.

TABLE 6

A > N Editing Rate using guide SGN000194

| Deaminase | | A6 | A10 | A13 | A15 | A21 | A23 | A26 | A27 |
|---|---|---|---|---|---|---|---|---|---|
| APG09982 | C | 0 | 0 | 0 | 0 | 0 | 0 | 0 | 0 |
| | G | 0 | 0.3 | 0.6 | 1.5 | 0 | 0 | 0 | 0 |
| | T | 0 | 0 | 0 | 0 | 0 | 0 | 0 | 0 |
| APG03724 | C | 0 | 0 | 0 | 0 | 0 | 0 | 0 | 0 |
| | G | 0 | 0.1 | 0.3 | 1 | 0 | 0 | 0 | 0 |
| | T | 0 | 0 | 0 | 0 | 0 | 0 | 0 | 0 |
| APG09949 | C | 0 | 0 | 0 | 0 | 0 | 0 | 0 | 0 |
| | G | 0 | 0.2 | 0.3 | 1.6 | 0 | 0 | 0 | 0 |
| | T | 0 | 0 | 0 | 0 | 0 | 0 | 0 | 0 |
| APG08196 | C | 0 | 0 | 0 | 0 | 0 | 0 | 0 | 0 |
| | G | 0.1 | 0.4 | 0.1 | 0.9 | 0 | 0 | 0 | 0 |
| | T | 0 | 0 | 0 | 0 | 0 | 0 | 0 | 0 |
| APG06333 | C | 0 | 0 | 0 | 0 | 0 | 0 | 0 | 0 |
| | G | 0 | 0.2 | 0.3 | 1 | 0 | 0 | 0 | 0 |
| | T | 0 | 0 | 0 | 0 | 0 | 0 | 0 | 0 |
| APG06489 | C | 0 | 0 | 0 | 0 | 0 | 0 | 0 | 0 |
| | G | 0 | 0.4 | 0.2 | 1.1 | 0 | 0 | 0 | 0 |
| | T | 0 | 0 | 0 | 0 | 0 | 0 | 0 | 0 |
| APG08449 | C | 0 | 0 | 0 | 0 | 0 | 0 | 0 | 0 |
| | G | 0.1 | 0.3 | 0.4 | 1.8 | 0 | 0 | 0 | 0 |
| | T | 0 | 0 | 0 | 0 | 0 | 0 | 0 | 0 |
| APG05174 | C | 0 | 0 | 0 | 0 | 0 | 0 | 0 | 0 |
| | G | 0.1 | 0.1 | 0.3 | 0.9 | 0 | 0 | 0 | 0 |
| | T | 0 | 0 | 0 | 0 | 0 | 0 | 0 | 0 |
| APG09102 | C | 0 | 0 | 0 | 0 | 0 | 0 | 0 | 0 |
| | G | 0 | 0.2 | 0.7 | 1.6 | 0 | 0 | 0 | 0 |
| | T | 0 | 0 | 0 | 0 | 0 | 0 | 0 | 0 |
| APG05723 | C | 0 | 0 | 0 | 0 | 0 | 0 | 0 | 0 |
| | G | 0 | 0 | 0.1 | 0.9 | 0 | 0 | 0 | 0 |
| | T | 0 | 0 | 0 | 0 | 0 | 0 | 0 | 0 |

With SGN00194, all fusion proteins showed 0.9%-1.8% A>G editing at position A15. No detectable editing was seen in positions A21, A23, A26 and A27.

TABLE 7

A > N Editing Rate using guide SGN000930

| Deaminase | | A2 | A4 | A5 | A8 | A9 | A10 | A14 | A15 | A16 | A20 | A21 | A23 | A24 | A26 | A27 | A29 | A30 |
|---|---|---|---|---|---|---|---|---|---|---|---|---|---|---|---|---|---|---|
| APG09982 | C | 0 | 0 | 0 | 0 | 0 | 0 | 0 | 0 | 0 | 0 | 0 | 0 | 0 | 0 | 0 | 0 | 0 |
| | G | 0 | 0 | 0 | 0 | 0 | 0.3 | 0.7 | 0.1 | 0.2 | 0.5 | 0.2 | 0 | 0 | 0 | 0 | 0 | 0 |
| | T | 0 | 0 | 0 | 0 | 0 | 0 | 0 | 0 | 0 | 0 | 0 | 0 | 0 | 0 | 0 | 0 | 0 |
| APG03724 | C | 0 | 0 | 0 | 0 | 0 | 0 | 0 | 0 | 0 | 0 | 0 | 0 | 0 | 0 | 0 | 0 | 0 |
| | G | 0 | 0 | 0 | 0.1 | 0.1 | 0.4 | 0.5 | 0.2 | 0.2 | 0.3 | 0.1 | 0 | 0 | 0 | 0 | 0 | 0 |
| | T | 0 | 0 | 0 | 0 | 0 | 0 | 0 | 0 | 0 | 0 | 0 | 0 | 0 | 0 | 0 | 0 | 0 |
| APG09949 | C | 0 | 0 | 0 | 0 | 0 | 0 | 0 | 0 | 0 | 0 | 0 | 0 | 0 | 0 | 0 | 0 | 0 |
| | G | 0 | 0 | 0 | 0 | 0 | 0.1 | 0.5 | 0.3 | 0.3 | 0.4 | 0 | 0 | 0 | 0 | 0 | 0 | 0 |
| | T | 0 | 0 | 0 | 0 | 0 | 0 | 0 | 0 | 0 | 0 | 0 | 0 | 0 | 0 | 0 | 0 | 0 |
| APG08196 | C | 0 | 0 | 0 | 0 | 0 | 0 | 0 | 0 | 0 | 0 | 0 | 0 | 0 | 0 | 0 | 0 | 0 |
| | G | 0 | 0 | 0 | 0.1 | 0 | 0.2 | 0.7 | 0.3 | 0.2 | 0.4 | 0.1 | 0 | 0 | 0 | 0 | 0 | 0 |
| | T | 0 | 0 | 0 | 0 | 0 | 0 | 0 | 0 | 0 | 0 | 0 | 0 | 0 | 0 | 0 | 0 | 0 |
| APG06333 | C | 0 | 0 | 0 | 0 | 0 | 0 | 0 | 0 | 0 | 0 | 0 | 0 | 0 | 0 | 0 | 0 | 0 |
| | G | 0 | 0 | 0 | 0.1 | 0.1 | 0 | 0.3 | 0.4 | 0.3 | 0.9 | 0.2 | 0.1 | 0.1 | 0 | 0 | 0 | 0 |
| | T | 0 | 0 | 0 | 0 | 0 | 0 | 0 | 0 | 0 | 0 | 0 | 0 | 0 | 0 | 0 | 0 | 0 |
| APG06489 | C | 0 | 0 | 0 | 0 | 0 | 0 | 0 | 0 | 0 | 0 | 0 | 0 | 0 | 0 | 0 | 0 | 0 |
| | G | 0 | 0 | 0 | 0.3 | 0.1 | 0.2 | 0.8 | 0.3 | 0.4 | 0.6 | 0 | 0.1 | 0 | 0 | 0 | 0 | 0 |
| | T | 0 | 0 | 0 | 0 | 0 | 0 | 0 | 0 | 0 | 0 | 0 | 0 | 0 | 0 | 0 | 0 | 0 |
| APG08449 | C | 0 | 0 | 0 | 0 | 0 | 0 | 0 | 0 | 0 | 0 | 0 | 0 | 0 | 0 | 0 | 0 | 0 |
| | G | 0 | 0 | 0 | 0.1 | 0.1 | 0.3 | 0.6 | 0.4 | 0.2 | 0.4 | 0.1 | 0 | 0 | 0 | 0 | 0 | 0 |
| | T | 0 | 0 | 0 | 0 | 0 | 0 | 0 | 0 | 0 | 0 | 0 | 0 | 0 | 0 | 0 | 0 | 0 |
| APG05174 | C | 0 | 0 | 0 | 0 | 0 | 0 | 0 | 0 | 0 | 0 | 0 | 0 | 0 | 0 | 0 | 0 | 0 |
| | G | 0 | 0 | 0 | 0 | 0.1 | 0.2 | 0.8 | 0.3 | 0.4 | 0.2 | 0.2 | 0 | 0 | 0 | 0 | 0 | 0 |
| | T | 0 | 0 | 0 | 0 | 0 | 0 | 0 | 0 | 0 | 0 | 0 | 0 | 0 | 0 | 0 | 0 | 0 |
| APG09102 | C | 0 | 0 | 0 | 0 | 0 | 0 | 0 | 0 | 0 | 0 | 0 | 0 | 0 | 0 | 0 | 0 | 0 |
| | G | 0 | 0 | 0 | 0 | 0 | 0 | 0.9 | 0.1 | 0.1 | 0.6 | 0.3 | 0 | 0 | 0 | 0 | 0 | 0 |
| | T | 0 | 0 | 0 | 0 | 0 | 0 | 0 | 0 | 0 | 0 | 0 | 0 | 0 | 0 | 0 | 0 | 0 |
| APG05723 | C | 0 | 0 | 0 | 0 | 0 | 0 | 0 | 0 | 0 | 0 | 0 | 0 | 0 | 0 | 0 | 0 | 0 |
| | G | 0 | 0 | 0 | 0 | 0.1 | 0.1 | 1.2 | 0.6 | 0.2 | 0.5 | 0 | 0 | 0 | 0 | 0 | 0 | 0 |
| | T | 0 | 0 | 0 | 0 | 0 | 0 | 0 | 0 | 0 | 0 | 0 | 0 | 0 | 0 | 0 | 0 | 0 |

A14 was the most highly edited position in SGN000930 with all fusion proteins tested. The editing rate ranged from 0.3%-1.2% for A>G conversions.

Example 2: Fluorescence Assay for Targeted Adenine Base Editing

A vector harboring Enhanced Green Fluorescent Protein (EGFP) containing a W58X mutation which causes a premature stop codon (GFP-STOP, SEQ ID NO: 47) was constructed such that the W58 codon can be reverted from a stop codon (TGA) to the wild-type tryptophan (TGG) residue using an adenine deaminase to alter the third position A to G. Successful A to G conversion results in the expression of EGFP which can be quantified. A second vector capable of expressing a guide RNA which targets the deaminase-RGN fusion protein to the region around the W58X mutation (SEQ ID NO: 48) was also produced.

This GFP-STOP reporter vector, along with the vectors capable of expressing a deaminase-nRGN fusion protein and the corresponding guide RNA, were transfected into HEK293T cells, using either lipofection or electroporation. For lipofection, cells were seeded at 1×10⁵ cells/well in 24-well plates the day prior to transfection in growth medium (DMEM+10% Fetal Bovine Serum+1% Penicillin/streptomycin), 500 ng each of the GFP-STOP reporter vector, deaminase-RGN expression vector, and guide RNA expression vector were transfected using Lipofectamine® 3000 reagent (Thermo Fisher Scientific) following manufacturer's instructions. For electroporation, cells were electroporated using the Neon® Transfection System (Thermo Fisher Scientific) following manufacturer's instructions.

In addition to transient transfection of the fluorescent GFP-STOP reporter, a stable cell line harboring a chromosomally integrated GFP-STOP cassette was generated. Once the stable line was established, for transfection, cells were seeded at 1×10⁵ cells/well in 24-well plates the day prior to transfection in growth medium (DMEM+10% Fetal Bovine Serum+1% Penicillin/streptomycin). 500 mg each of the deaminase-nRGN expression vector and guide RNA expression vector were transfected using Lipofectamine® 3000 reagent (Thermo Fisher Scientific) following manufacturer's instructions. For electroporation, cells were electroporated using the Neon® Transfection System (Thermo Fisher Scientific) following manufacturer's instructions.

24-48 hours after lipofection or electroporation, the expression of GFP was determined by microscopically surveying the cells for the presence of GFP+ cells. Following visual inspection, the proportion of GFP+ cells versus GFP– cells may be determined. Fluorescence was observed in mammalian cells expressing each of the deaminase-nRGN fusion proteins, indicating the fusion protein successfully targeted to the GFP-STOP mutation and edited the mutation to restore fluorescence of the GFP protein.

Following microscopic analysis, the cells were lysed in RIPA buffer and the resulting lysate was analyzed on a fluorescence plate reader to determine the fluorescence intensity of GFP (Table 8), A person of skill in the art will appreciate that the cells may be analyzed by flow cytometry or fluorescence activated cell sorting to determine the exact proportions of GFP+ and GFP– cells.

TABLE 8

GFP-STOP assay results

| Deaminase of fusion protein | GFP+ cells detected |
|---|---|
| APG09982 | ++ |
| APG03724 | ++ |
| APG09949 | ++ |
| APG08196 | ++ |
| APG06333 | +++ |
| APG06489 | ++ |
| APG08449 | ++ |
| APG05174 | +++ |
| APG09102 | ++ |
| APG05723 | ++ |

N.D = None Detected;
+ = few GFP+ cells detected;
++ = several GFP+ cells detected;
+++ = many GFP+ cells detected Example 3: Demonstration of a Base Editing in Mammalian Cells The deaminases shown in Table 9 below were produced based on naturally occurring deaminases which were then mutated and selected for adenine deaminase activity in prokaryotic cells.

TABLE 9

Deaminase sequences

| Deaminase | SEQ ID NO. |
|---|---|
| LPG50140 | 399 |
| LPG50141 | 400 |
| LPG50142 | 401 |
| LPG50143 | 402 |
| LPG50144 | 403 |
| LPG50145 | 404 |
| LPG50146 | 405 |
| LPG50147 | 406 |
| LPG50148 | 407 |
| LPG50149 | 408 |
| LPG50150 | 409 |
| LPG50151 | 410 |
| LPG50152 | 411 |
| LPG50153 | 412 |
| LPG50154 | 413 |
| LPG50155 | 414 |
| LPG50156 | 415 |
| LPG50157 | 416 |
| LPG50158 | 417 |
| LPG50159 | 418 |
| LPG50160 | 419 |
| LPG50161 | 420 |
| LPG50162 | 421 |
| LPG50163 | 422 |
| LPG50164 | 423 |
| LPG50165 | 424 |
| LPG50166 | 425 |
| LPG50167 | 426 |
| LPG50168 | 427 |
| LPG50169 | 428 |
| LPG50170 | 429 |
| LPG50171 | 430 |
| LPG50172 | 431 |
| LPG50173 | 432 |
| LPG50174 | 433 |
| LPG50175 | 434 |
| LPG50176 | 435 |
| LPG50177 | 436 |
| LPG50178 | 437 |
| LPG50179 | 438 |
| LPG50180 | 439 |

TABLE 9-continued

Deaminase sequences

| Deaminase | SEQ ID NO. |
|---|---|
| LPG50181 | 440 |
| LPG50182 | 441 |

To determine if the deaminases of Table 9 are able to perform adenine base editing in mammalian cells, each deaminase was operably fused to an RGN nickase to produce a fusion protein. Residues predicted to deactivate the RuvC domain of the RGN APG07433.1 (set forth as SEQ ID NO: 41; described in PCT publication WO 2019/236566, incorporated by reference herein) were identified and the RGN was modified to a nickase variant (nAPG07433.1; SEQ ID NO: 42). A nickase variant of an RGN is referred to herein as "nRGN". It should be understood that any nickase variant of an RGN may be used to produce a fusion protein of the invention.

Deaminase and nRGN nucleotide sequences codon optimized for mammalian expression were synthesized as fusion proteins with an N-terminal nuclear localization tag and cloned into the pTwist CMV (Twist Biosciences) expression plasmid. Each fusion protein comprises, starting at the amino terminus, the SV40 NLS (SEQ ID NO: 43) operably linked at the C-terminal end to 3×FLAG Tag (SEQ ID NO: 44), operably linked at the C-terminal end to a deaminase, operably linked at the C-terminal end to a peptide linker (SEQ ID NO: 442), operably linked at the C-terminal end to an nRGN (for example, nAPG07433.1, which is SEQ ID NO: 42), finally operably linked at the C-terminal end to the nucleoplasmin NLS (SEQ ID NO: 46). The nAPG07433.1 and peptide linker nucleotide sequences codon optimized for mammalian expression are set forth as SEQ ID NOs: 486 and 487, respectively. Table 10 shows the fusion proteins produced and tested for activity. All fusion proteins comprise at least one NLS and a 3× FLAG Tag, as described above.

TABLE 10

Fusion protein sequences with N-terminus SV40 NLS,
3X FLAG Tag and C-terminus Nucleoplasmin NLS

| Fusion Protein | SEQ ID |
|---|---|
| LPG50140-nAPG07433.1 | 488 |
| LPG50141-nAPG07433.1 | 489 |
| LPG50142-nAPG07433.1 | 490 |
| LPG50143-nAPG07433.1 | 491 |
| LPG50144-nAPG07433.1 | 492 |
| LPG50145-nAPG07433.1 | 493 |
| LPG50146-nAPG07433.1 | 494 |
| LPG50147-nAPG07433.1 | 495 |
| LPG50148-nAPG07433.1 | 496 |
| LPG50149-nAPG07433.1 | 497 |
| LPG50150-nAPG07433.1 | 498 |
| LPG50151-nAPG07433.1 | 499 |
| LPG50152-nAPG07433.1 | 500 |
| LPG50153-nAPG07433.1 | 501 |
| LPG50154-nAPG07433.1 | 502 |
| LPG50155-nAPG07433.1 | 503 |
| LPG50156-nAPG07433.1 | 504 |
| LPG50157-nAPG07433.1 | 505 |
| LPG50158-nAPG07433.1 | 506 |
| LPG50159-nAPG07433.1 | 507 |
| LPG50160-nAPG07433.1 | 508 |
| LPG50161-nAPG07433.1 | 509 |
| LPG50162-nAPG07433.1 | 510 |
| LPG50163-nAPG07433.1 | 511 |
| LPG50164-nAPG07433.1 | 512 |

TABLE 10-continued

Fusion protein sequences with N-terminus SV40 NLS,
3X FLAG Tag and C-terminus Nucleoplasmin NLS

| Fusion Protein | SEQ ID |
|---|---|
| LPG50165-nAPG07433.1 | 513 |
| LPG50166-nAPG07433.1 | 514 |
| LPG50167-nAPG07433.1 | 515 |
| LPG50168-nAPG07433.1 | 516 |
| LPG50169-nAPG07433.1 | 517 |
| LPG50170-nAPG07433.1 | 518 |
| LPG50171-nAPG07433.1 | 519 |
| LPG50172-nAPG07433.1 | 520 |
| LPG50173-nAPG07433.1 | 521 |
| LPG50174-nAPG07433.1 | 522 |
| LPG50175-nAPG07433.1 | 523 |
| LPG50176-nAPG07433.1 | 524 |
| LPG50177-nAPG07433.1 | 525 |
| LPG50178-nAPG07433.1 | 526 |
| LPG50179-nAPG07433.1 | 527 |
| LPG50180-nAPG07433.1 | 528 |
| LPG50181-nAPG07433.1 | 529 |
| LPG50182-nAPG07433.1 | 530 |

Expression plasmids comprising an expression cassette encoding for a sgRNA were also produced. Human genomic target sequences and the sgRNA sequences for guiding the fusion proteins to the genomic targets are indicated in Table 11.

TABLE 11

Guide RNA sequences

| sgRNA ID | Target sequence | sgRNA sequence | Forward Primer for amplification | Reverse Primer for amplification |
|---|---|---|---|---|
| SGN000139 | 537 | 531 | 543 | 549 |
| SGN000143 | 538 | 532 | 544 | 550 |
| SGN000186 | 539 | 533 | 545 | 551 |
| SGN000194 | 540 | 534 | 546 | 552 |
| SGN000930 | 541 | 535 | 547 | 553 |
| SGN001681 | 542 | 536 | 548 | 554 |

500 ng of plasmid comprising an expression cassette comprising a coding sequence for a fusion protein shown in Table 10 and 500 ng of plasmid comprising an expression cassette encoding for an sgRNA shown in Table 11 were co-transfected into HEK293FT cells at 75-90% confluency in 24-well plates using Lipofectamine 2000 reagent (Life Technologies). Cells were then incubated at 37° C. for 72 h. Following incubation, genomic DNA was then extracted using NucleoSpin 96 Tissue (Macherey-Nagel) following the manufacturer's protocol. The genomic region flanking the targeted genomic site was PCR amplified using the primers in Table 11 and products were purified using ZR-96 DNA Clean and Concentrator (Zymo Research) following the manufacturer's protocol. The purified PCR products underwent Next Generation Sequencing on Illumina MiSeq. Typically, 100,000 of 250 bp paired-end reads (2×100,000 reads) are generated per amplicon. The reads were analyzed using CRISPResso (Pinello, et al. 2016 Nature Biotech, 34:695-697) to calculate the rates of editing. Output alignments were analyzed for INDEL formation or introduction of specific adenine mutations.

Table 12 shows all of the adenine base editing for each adenine deaminase fusion in Table 10 and a guide RNA from Table 12. Tables 13-27 show the specific nucleotide mutation profile for select exemplary samples. The editing rate for adenines within or proximal to the target sequence is indicated. "A5" indicates, for example, an adenine at position 5 of the target sequence. The position of each nucleotide in the target sequence was determined by numbering the first nucleotide in the target sequence closest to the PAM (which is 3' of the target for APG07433.1) as position 1, and the position number increases in the 5' direction away from the PAM sequence. The tables also show which nucleotide the adenine was changed to, and at what rate. For example, Table 13 shows that for the LPG50148-nAPG07433.1 fusion protein, the adenine at position 13 was mutated to a guanine at a rate of 9.7%.

TABLE 12

Estimate of base editing rates for each adenine deaminase

| Deaminase | SGN | % Mutated Reads |
|---|---|---|
| LPG50140 | SGN001681 | 30.01% |
| LPG50140 | SGN000139 | 6.91% |
| LPG50140 | SGN000143 | 16.09% |
| LPG50140 | SGN000186 | 18.76% |
| LPG50140 | SGN000194 | 9.77% |
| LPG50140 | SGN000930 | 3.51% |
| LPG50141 | SGN001681 | 21.37% |
| LPG50141 | SGN000139 | 2.43% |
| LPG50141 | SGN000143 | 6.93% |
| LPG50141 | SGN000186 | 9.79% |
| LPG50141 | SGN000194 | 4.45% |
| LPG50141 | SGN000930 | 5.29% |
| LPG50142 | SGN001681 | 34.19% |
| LPG50142 | SGN000139 | 3.10% |
| LPG50142 | SGN000143 | 8.67% |
| LPG50142 | SGN000186 | 14.12% |
| LPG50142 | SGN000194 | 10.04% |
| LPG50142 | SGN000930 | 6.78% |
| LPG50143 | SGN001681 | 20.62% |
| LPG50143 | SGN000139 | 1.99% |
| LPG50143 | SGN000143 | 6.09% |
| LPG50143 | SGN000186 | 10.58% |
| LPG50143 | SGN000194 | 5.60% |
| LPG50143 | SGN000930 | 3.98% |
| LPG50144 | SGN001681 | 28.26% |
| LPG50144 | SGN000139 | 3.55% |
| LPG50144 | SGN000143 | 5.77% |
| LPG50144 | SGN000186 | 12.22% |
| LPG50144 | SGN000194 | 6.40% |
| LPG50144 | SGN000930 | 5.81% |
| LPG50145 | SGN001681 | 29.23% |
| LPG50145 | SGN000139 | 2.53% |
| LPG50145 | SGN000143 | 3.75% |
| LPG50145 | SGN000186 | 9.93% |
| LPG50145 | SGN000194 | 3.98% |
| LPG50145 | SGN000930 | 3.84% |
| LPG50146 | SGN001681 | 32.53% |
| LPG50146 | SGN000139 | 5.95% |
| LPG50146 | SGN000143 | 11.30% |
| LPG50146 | SGN000186 | 17.78% |
| LPG50146 | SGN000194 | 7.38% |
| LPG50146 | SGN000930 | 7.13% |
| LPG50147 | SGN001681 | 49.10% |
| LPG50147 | SGN000139 | 3.26% |
| LPG50147 | SGN000143 | 8.59% |
| LPG50147 | SGN000186 | 12.61% |
| LPG50147 | SGN000194 | 8.80% |
| LPG50147 | SGN000930 | 4.96% |
| LPG50148 | SGN001681 | 49.39% |
| LPG50148 | SGN000139 | 10.80% |
| LPG50148 | SGN000143 | 12.49% |
| LPG50148 | SGN000186 | 32.65% |
| LPG50148 | SGN000194 | 16.60% |
| LPG50148 | SGN000930 | 7.61% |
| LPG50149 | SGN001681 | 27.62% |
| LPG50149 | SGN000139 | 2.83% |
| LPG50149 | SGN000143 | 9.33% |
| LPG50149 | SGN000186 | 22.12% |
| LPG50149 | SGN000194 | 7.94% |
| LPG50149 | SGN000930 | 7.06% |
| LPG50150 | SGN001681 | 28.46% |

TABLE 12-continued

Estimate of base editing rates for each adenine deaminase

| Deaminase | SGN | % Mutated Reads |
|---|---|---|
| LPG50150 | SGN000139 | 3.06% |
| LPG50150 | SGN000143 | 6.00% |
| LPG50150 | SGN000186 | 23.67% |
| LPG50150 | SGN000194 | 9.47% |
| LPG50150 | SGN000930 | 5.41% |
| LPG50151 | SGN001681 | 3.01% |
| LPG50151 | SGN000139 | 0% |
| LPG50151 | SGN000143 | 1.53% |
| LPG50151 | SGN000186 | 7.76% |
| LPG50151 | SGN000194 | 1.43% |
| LPG50151 | SGN000930 | 0% |
| LPG50152 | SGN001681 | 26.06% |
| LPG50152 | SGN000139 | 2% |
| LPG50152 | SGN000143 | 3% |
| LPG50152 | SGN000186 | 18% |
| LPG50152 | SGN000194 | 3% |
| LPG50152 | SGN000930 | 6% |
| LPG50153 | SGN001681 | 1.12% |
| LPG50153 | SGN000139 | 0% |
| LPG50153 | SGN000143 | 0% |
| LPG50153 | SGN000186 | 0% |
| LPG50153 | SGN000194 | 1% |
| LPG50153 | SGN000930 | 0% |
| LPG50154 | SGN001681 | 2.26% |
| LPG50154 | SGN000139 | 0% |
| LPG50154 | SGN000143 | 0% |
| LPG50154 | SGN000186 | 0% |
| LPG50154 | SGN000194 | 1% |
| LPG50154 | SGN000930 | 0% |
| LPG50155 | SGN001681 | 14.91% |
| LPG50155 | SGN000139 | 2% |
| LPG50155 | SGN000143 | 4% |
| LPG50155 | SGN000186 | 17% |
| LPG50155 | SGN000194 | 7% |
| LPG50155 | SGN000930 | 5% |
| LPG50156 | SGN001681 | 11.19% |
| LPG50156 | SGN000139 | 3.79% |
| LPG50156 | SGN000143 | 6.44% |
| LPG50156 | SGN000186 | 12.69% |
| LPG50156 | SGN000194 | 6.87% |
| LPG50156 | SGN000930 | 4.10% |
| LPG50157 | SGN001681 | 20.66% |
| LPG50157 | SGN000139 | 3.37% |
| LPG50157 | SGN000143 | 6.91% |
| LPG50157 | SGN000186 | 12.15% |
| LPG50157 | SGN000194 | 9.98% |
| LPG50157 | SGN000930 | 5.55% |
| LPG50158 | SGN001681 | 1.56% |
| LPG50158 | SGN000139 | 0% |
| LPG50158 | SGN000143 | 1.15% |
| LPG50158 | SGN000186 | 4.91% |
| LPG50158 | SGN000194 | 1.73% |
| LPG50158 | SGN000930 | 0% |
| LPG50159 | SGN001681 | 5.85% |
| LPG50159 | SGN000139 | 0% |
| LPG50159 | SGN000143 | 2.78% |
| LPG50159 | SGN000186 | 6.99% |
| LPG50159 | SGN000194 | 4.40% |
| LPG50159 | SGN000930 | 2.60% |
| LPG50160 | SGN001681 | 22.20% |
| LPG50160 | SGN000139 | 4% |
| LPG50160 | SGN000143 | 8% |
| LPG50160 | SGN000186 | 16% |
| LPG50160 | SGN000194 | 5% |
| LPG50160 | SGN000930 | 6% |
| LPG50161 | SGN001681 | 1.47% |
| LPG50161 | SGN000139 | 0% |
| LPG50161 | SGN000143 | 0% |
| LPG50161 | SGN000186 | 0% |
| LPG50161 | SGN000194 | 0% |
| LPG50161 | SGN000930 | 0% |
| LPG50162 | SGN001681 | 21.73% |
| LPG50162 | SGN000139 | 2% |
| LPG50162 | SGN000143 | 5% |
| LPG50162 | SGN000186 | 14% |
| LPG50162 | SGN000194 | 6% |

TABLE 12-continued

Estimate of base editing rates for each adenine deaminase

| Deaminase | SGN | % Mutated Reads |
|---|---|---|
| LPG50162 | SGN000930 | 5% |
| LPG50163 | SGN001681 | 12.80% |
| LPG50163 | SGN000139 | 0% |
| LPG50163 | SGN000143 | 2% |
| LPG50163 | SGN000186 | 10% |
| LPG50163 | SGN000194 | 4% |
| LPG50163 | SGN000930 | 3% |
| LPG50164 | SGN001681 | 4.28% |
| LPG50164 | SGN000139 | 0% |
| LPG50164 | SGN000143 | 3.36% |
| LPG50164 | SGN000186 | 7.38% |
| LPG50164 | SGN000194 | 2.73% |
| LPG50164 | SGN000930 | 1.47% |
| LPG50165 | SGN001681 | 25.66% |
| LPG50165 | SGN000139 | 2% |
| LPG50165 | SGN000143 | 5.11% |
| LPG50165 | SGN000186 | 9.88% |
| LPG50165 | SGN000194 | 3.97% |
| LPG50165 | SGN000930 | 3.18% |
| LPG50166 | SGN000139 | 2% |
| LPG50166 | SGN000143 | 4% |
| LPG50166 | SGN000186 | 8% |
| LPG50166 | SGN000194 | 2% |
| LPG50166 | SGN000930 | 4% |
| LPG50167 | SGN001681 | 20.56% |
| LPG50167 | SGN000139 | 2% |
| LPG50167 | SGN000143 | 4% |
| LPG50167 | SGN000186 | 8% |
| LPG50167 | SGN000194 | 5% |
| LPG50167 | SGN000930 | 4% |
| LPG50168 | SGN001681 | 13.81% |
| LPG50168 | SGN000139 | 2% |
| LPG50168 | SGN000143 | 3% |
| LPG50168 | SGN000186 | 7% |
| LPG50168 | SGN000194 | 2% |
| LPG50168 | SGN000930 | 3% |
| LPG50169 | SGN001681 | 25.73% |
| LPG50169 | SGN000139 | 4% |
| LPG50169 | SGN000143 | 8% |
| LPG50169 | SGN000186 | 13% |
| LPG50169 | SGN000194 | 9% |
| LPG50169 | SGN000930 | 8% |
| LPG50170 | SGN001681 | 12.87% |
| LPG50170 | SGN000139 | 1.50% |
| LPG50170 | SGN000143 | 3.14% |
| LPG50170 | SGN000186 | 12.16% |
| LPG50170 | SGN000194 | 2.76% |
| LPG50170 | SGN000930 | 4.10% |
| LPG50171 | SGN001681 | 27.16% |
| LPG50171 | SGN000139 | 1.75% |
| LPG50171 | SGN000143 | 6.14% |
| LPG50171 | SGN000186 | 12.65% |
| LPG50171 | SGN000194 | 5.60% |
| LPG50171 | SGN000930 | 4.55% |
| LPG50172 | SGN001681 | 1.78% |
| LPG50172 | SGN000139 | 0% |
| LPG50172 | SGN000143 | 0% |
| LPG50172 | SGN000186 | 0% |
| LPG50172 | SGN000194 | 0% |
| LPG50172 | SGN000930 | 0% |
| LPG50173 | SGN001681 | 12.64% |
| LPG50173 | SGN000139 | 1.00% |
| LPG50173 | SGN000143 | 3.23% |
| LPG50173 | SGN000186 | 7.88% |
| LPG50173 | SGN000194 | 2.66% |
| LPG50173 | SGN000930 | 1.77% |
| LPG50174 | SGN001681 | 14.11% |
| LPG50174 | SGN000139 | 0% |
| LPG50174 | SGN000143 | 3% |
| LPG50174 | SGN000186 | 8% |
| LPG50174 | SGN000194 | 2% |
| LPG50174 | SGN000930 | 3% |
| LPG50175 | SGN001681 | 22.29% |
| LPG50175 | SGN000139 | 4% |
| LPG50175 | SGN000143 | 9% |
| LPG50175 | SGN000186 | 14% |
| LPG50175 | SGN000194 | 13% |
| LPG50175 | SGN000930 | 5% |
| LPG50176 | SGN001681 | 9.52% |
| LPG50176 | SGN000139 | 0% |
| LPG50176 | SGN000143 | 2% |
| LPG50176 | SGN000186 | 7% |
| LPG50176 | SGN000194 | 2% |
| LPG50176 | SGN000930 | 0% |
| LPG50177 | SGN001681 | 7.98% |
| LPG50177 | SGN000139 | 2% |
| LPG50177 | SGN000143 | 4% |
| LPG50177 | SGN000186 | 11% |
| LPG50177 | SGN000194 | 3% |
| LPG50177 | SGN000930 | 9% |
| LPG50178 | SGN000139 | 2.00% |
| LPG50178 | SGN000143 | 6.19% |
| LPG50178 | SGN000186 | 12.94% |
| LPG50178 | SGN000194 | 5.51% |
| LPG50178 | SGN000930 | 3.95% |
| LPG50179 | SGN001681 | 23.35% |
| LPG50179 | SGN000139 | 2.00% |
| LPG50179 | SGN000143 | 5.08% |
| LPG50179 | SGN000186 | 12.50% |
| LPG50179 | SGN000194 | 4.49% |
| LPG50179 | SGN000930 | 4.62% |
| LPG50180 | SGN001681 | 1.80% |
| LPG50180 | SGN000139 | 0% |
| LPG50180 | SGN000143 | 0% |
| LPG50180 | SGN000186 | 0% |
| LPG50180 | SGN000194 | 0% |
| LPG50180 | SGN000930 | 0% |
| LPG50181 | SGN001681 | 7.93% |
| LPG50181 | SGN000139 | 2.88% |
| LPG50181 | SGN000143 | 3.78% |
| LPG50181 | SGN000186 | 12.56% |
| LPG50181 | SGN000194 | 3.39% |
| LPG50181 | SGN000930 | 1.20% |
| LPG50182 | SGN001681 | 16.49% |
| LPG50182 | SGN000139 | 1.00% |
| LPG50182 | SGN000143 | 5% |
| LPG50182 | SGN000186 | 9% |
| LPG50182 | SGN000194 | 6% |
| LPG50182 | SGN000930 | 3% |

TABLE 13

A > N Editing Rate using deaminase LPG50148 and guide SGN000139

| | | SGN000139 | | | | |
|---|---|---|---|---|---|---|
| | | A5 | A12 | A13 | A20 | A22 |
| LPG50148 | C | 0 | 0 | 0 | 0.1 | 0 |
| | G | 0 | 2.2 | 9.7 | 0.2 | 0 |
| | T | 0 | 0 | 0 | 0 | 0 |

LPG50140, LPG50146, and LPG50148 showed detectable A > G conversion at positions A12 and A13. LPG50148 showed over 9% editing at position A13.

TABLE 14

A > N Editing Rate using deaminase LPG50148 and guide SGN000143

| | | SGN000143 | | | | | | | |
|---|---|---|---|---|---|---|---|---|---|
| | | A1 | A4 | A6 | A9 | A11 | A14 | A19 | A30 |
| LPG50148 | C | 0 | 0 | 0 | 0 | 0 | 0 | 0 | 0 |
| | G | 0 | 0 | 0.1 | 1.2 | 11 | 6.7 | 0.1 | 0 |
| | T | 0 | 0 | 0 | 0 | 0 | 0 | 0 | 0 |

LPG50140, LPG50146, and LPG50148 showed detectable A > G conversion at positions A9, A11 and A14. LPG50148 showed over 11% editing at position A11.

TABLE 15

A > N Editing Rate using deaminase LPG50148 and guide SGN000186

| | | \multicolumn{7}{c}{SGN000186} | | | | | | |
|---|---|---|---|---|---|---|---|---|
| | | A9 | A16 | A18 | A22 | A25 | A28 | A30 |
| LPG50148 | C | 0 | 0 | 0 | 0 | 0.4 | 0 | 0 |
| | G | 23.7 | 29.2 | 4.1 | 0.2 | 0 | 0 | 0 |
| | T | 0 | 0 | 0 | 0 | 0 | 0 | 0 |

LPG50140, LPG50146, and LPG50148 showed detectable A > G conversion at positions A9, A16 and A18. LPG50148 showed over 23% editing at positions A9 and A16.

TABLE 16

A > N Editing Rate using deaminase LPG50148 and guide SGN000194

| | | \multicolumn{8}{c}{SGN000194} | | | | | | | |
|---|---|---|---|---|---|---|---|---|---|
| | | A6 | A10 | A13 | A15 | A21 | A23 | A26 | A27 |
| LPG50148 | C | 0 | 0 | 0 | 0 | 0 | 0 | 0 | 0 |
| | G | 0.3 | 5.3 | 13 | 14 | 0 | 0 | 0 | 0 |
| | T | 0 | 0 | 0 | 0 | 0 | 0 | 0 | 0 |

LPG50140, LPG50146, and LPG50148 showed detectable A > G conversion at positions A13 and A15. LPG50148 showed over 12% editing at positions A13 and A15.

TABLE 17

A > N Editing Rate using deaminase LPG50148 and guide SGN000930

| | | \multicolumn{16}{c}{SGN000930} | | | | | | | | | | | | | | | |
|---|---|---|---|---|---|---|---|---|---|---|---|---|---|---|---|---|---|
| | | A2 | A4 | A5 | A8 | A9 | A10 | A14 | A15 | A16 | A20 | A21 | A23 | A24 | A26 | A27 | A29 | A30 |
| LPG50148 | C | 0 | 0 | 0 | 0 | 0 | 0 | 0 | 0 | 0 | 0 | 0 | 0 | 0 | 0 | 0 | 0 | 0 |
| | G | 0 | 0 | 0 | 0 | 0.2 | 2 | 2.2 | 1.1 | 2.2 | 2.2 | 2.5 | 0 | 0 | 0 | 0 | 0 | 0 |
| | T | 0 | 0 | 0 | 0 | 0 | 0 | 0 | 0 | 0 | 0 | 0 | 0 | 0 | 0 | 0 | 0 | 0 |

LPG50140, LPG50146, and LPG50148 showed detectable A > G conversion at positions A10, A14, A15, A16, A20 and A21. LPG50148 showed over 2% editing at positions A10, A14, A16, A20 and A21.

TABLE 18

A > N Editing Rate using deaminase LPG50146 and guide SGN000139

| | | \multicolumn{4}{c}{SGN000139} | | | |
|---|---|---|---|---|---|
| | | A5 | A12 | A13 | A20 | A22 |
| LPG50146 | C | 0 | 0 | 0 | 0.4 | 0.1 |
| | G | 0 | 2.1 | 4.1 | 0 | 0 |
| | T | 0 | 0 | 0 | 0 | 0 |

LPG50140, LPG50146, and LPG50148 showed detectable A > G conversion at positions A12 and A13. LPG50146 showed over 4% editing at position A13.

TABLE 19

A > N Editing Rate using deaminase LPG50146 and guide SGN000143

| | | \multicolumn{8}{c}{SGN000143} | | | | | | | |
|---|---|---|---|---|---|---|---|---|---|
| | | A1 | A4 | A6 | A9 | A11 | A14 | A19 | A30 |
| LPG50146 | C | 0 | 0 | 0 | 0 | 0 | 0 | 0 | 0 |
| | G | 0 | 0 | 0 | 0.8 | 8.4 | 5 | 0 | 0 |
| | T | 0 | 0 | 0 | 0 | 0 | 0 | 0 | 0 |

LPG50140, LPG50146, and LPG50148 showed detectable A > G conversion at positions A9, A11 and A14. LPG50146 showed over 8% editing at position A11.

TABLE 20

A > N Editing Rate using deaminase LPG50146 and guide SGN000186

| | | \multicolumn{7}{c}{SGN000186} | | | | | | |
|---|---|---|---|---|---|---|---|---|
| | | A9 | A16 | A18 | A22 | A25 | A28 | A30 |
| LPG50146 | C | 0 | 0 | 0 | 0 | 0.2 | 0 | 0 |
| | G | 7.4 | 13.4 | 3.1 | 0.1 | 0 | 0 | 0 |
| | T | 0 | 0 | 0 | 0 | 0 | 0 | 0 |

LPG50140, LPG50146, and LPG50148 showed detectable A > G conversion at positions A9, A16 and A18. LPG50146 showed over 13% editing at position A16.

TABLE 21

A > N Editing Rate using deaminase LPG50146 and guide SGN000194

| | | \multicolumn{8}{c}{SGN000194} |
|---|---|---|---|---|---|---|---|---|---|
| | | A6 | A10 | A13 | A15 | A21 | A23 | A26 | A27 |
| LPG50146 | C | 0 | 0 | 0 | 0 | 0 | 0 | 0 | 0 |
| | G | 0 | 1.8 | 3.2 | 4.5 | 0 | 0 | 0 | 0 |
| | T | 0 | 0 | 0 | 0 | 0 | 0 | 0 | 0 |

LPG50140, LPG50146, and LPG50148 showed detectable A > G conversion at positions A13 and A15. LPG50146 showed over 3% editing at positions A13 and A15.

TABLE 22

A > N Editing Rate using deaminase LPG50146 and guide SGN000930

| | | SGN000930 | | | | | | | | | | | | | | | |
|---|---|---|---|---|---|---|---|---|---|---|---|---|---|---|---|---|---|
| | | A2 | A4 | A5 | A8 | A9 | A10 | A14 | A15 | A16 | A20 | A21 | A23 | A24 | A26 | A27 | A29 | A30 |
| LPG50146 | C | 0 | 0 | 0 | 0 | 0 | 0 | 0 | 0 | 0 | 0 | 0 | 0 | 0 | 0 | 0 | 0 |
| | G | 0 | 0 | 0 | 0.1 | 0.1 | 0.7 | 2.9 | 2.6 | 2.4 | 1 | 0.8 | 0 | 0 | 0 | 0 | 0 |
| | T | 0 | 0 | 0 | 0 | 0 | 0 | 0 | 0 | 0 | 0 | 0 | 0 | 0 | 0 | 0 | 0 |

LPG50140, LPG50146, and LPG50148 showed detectable A > G conversion at positions A10, A14, A15, A16, A20 and A21. LPG50146 showed over 2% editing at positions A14 and A16.

TABLE 23

A > N Editing Rate using deaminase LPG50140 and guide SGN000139

| | | SGN000139 | | | | |
|---|---|---|---|---|---|---|
| | | A5 | A12 | A13 | A20 | A22 |
| LPG50140 | C | 0 | 0 | 0 | 0.4 | 0 |
| | G | 0 | 0.5 | 5.5 | 0 | 0 |
| | T | 0 | 0 | 0 | 0 | 0 |

LPG50140, LPG50146, and LPG50148 showed detectable A > G conversion at positions A12 and A13. LPG50140 showed over 5% editing at position A13.

TABLE 24

A > N Editing Rate using deaminase LPG50140 and guide SGN000143

| | | SGN000143 | | | | | | | |
|---|---|---|---|---|---|---|---|---|---|
| | | A1 | A4 | A6 | A9 | A11 | A14 | A19 | A30 |
| LPG50140 | C | 0 | 0 | 0 | 0 | 0 | 0 | 0 | 0 |
| | G | 0 | 0 | 0 | 1.2 | 14 | 5.6 | 0 | 0 |
| | T | 0 | 0 | 0 | 0 | 0 | 0 | 0 | 0 |

LPG50140, LPG50146, and LPG50148 showed detectable A > G conversion at positions A9, A11 and A14. LPG50140 showed 14% editing at position A11.

TABLE 25

A > N Editing Rate using deaminase LPG50140 and guide SGN000186

| | | SGN000186 | | | | | | |
|---|---|---|---|---|---|---|---|---|
| | | A9 | A16 | A18 | A22 | A25 | A28 | A30 |
| LPG50140 | C | 0 | 0 | 0 | 0 | 0.2 | 0 | 0 |
| | G | 9.4 | 15 | 1.7 | 0 | 0 | 0 | 0 |
| | T | 0 | 0 | 0 | 0 | 0 | 0 | 0 |

LPG50140, LPG50146, and LPG50148 showed detectable A > G conversion at positions A9, A16 and A18. LPG50140 showed over 9% editing at positions A9 and A16.

TABLE 26

A > N Editing Rate using deaminase LPG50140 and guide SGN000194

| | | \multicolumn{8}{c}{SGN000194} |
|---|---|---|---|---|---|---|---|---|---|
| | | A6 | A10 | A13 | A15 | A21 | A23 | A26 | A27 |
| LPG50140 | C | 0 | 0 | 0 | 0 | 0 | 0 | 0 | 0 |
| | G | 0 | 0 | 6.7 | 7.8 | 0 | 0 | 0 | 0 |
| | T | 0 | 0 | 0 | 0 | 0 | 0 | 0 | 0 |

LPG50140, LPG50146, and LPG50148 showed detectable A > G conversion at positions A13 and A15. LPG50140 showed over 6% editing at positions A13 and A15.

TABLE 27

A > N Editing Rate using deaminase LPG50140 and guide SGN000930

| | | \multicolumn{16}{c}{SGN000930} |
|---|---|---|---|---|---|---|---|---|---|---|---|---|---|---|---|---|---|
| | | A2 | A4 | A5 | A8 | A9 | A10 | A14 | A15 | A16 | A20 | A21 | A23 | A24 | A26 | A27 | A29 | A30 |
| LPG50140 | C | 0 | 0 | 0 | 0 | 0 | 0 | 0 | 0 | 0 | 0 | 0 | 0 | 0 | 0 | 0 | 0 |
| | G | 0 | 0 | 0 | 0 | 0 | 0.4 | 1.4 | 0.6 | 1.1 | 0.4 | 0.5 | 0 | 0 | 0 | 0 | 0 |
| | T | 0 | 0 | 0 | 0 | 0 | 0 | 0 | 0 | 0 | 0 | 0 | 0 | 0 | 0 | 0 | 0 |

LPG50140, LPG50146, and LPG50148 showed detectable A > G conversion at positions A10, A14, A15, A16, A20 and A21. LPG50140 showed over 1% editing at positions A14 and A16.

Table 28 below shows the average editing rates for LPG50148-nAPG07433.1 at several guides tested in HEK293T cells by lipofection of two plasmids. The base editor was encoded on one plasmid and the guide RNA was encoded on a second plasmid. Total substitution rate in the target is used to measure the base editing rate.

TABLE 28

Average Editing Rate for LPG50148-nAPG07433.1

| Gene | SGN | Average % Substitution rate | N |
|---|---|---|---|
| Gene A | SGN000139 | 10.8 | 1 |
| Gene A | SGN000143 | 29.65 | 2 |
| Gene B | SGN000487 | 34.68 | 2 |
| Gene B | SGN000488 | 39.94 | 1 |
| Gene B | SGN001061 | 9.18 | 2 |
| Gene B | SGN001062 | 32.77 | 1 |
| Gene B | SGN001270 | 8.34 | 3 |
| Gene B | SGN001946 | 5.1 | 1 |
| Gene B | SGN001947 | 16.43 | 1 |
| Gene B | SGN001948 | 0.46 | 1 |
| Gene B | SGN001949 | 1.44 | 1 |
| Gene B | SGN001950 | 10.96 | 1 |
| Gene B | SGN001951 | 5.38 | 1 |
| Gene B | SGN001952 | 6.29 | 1 |
| Gene B | SGN001953 | 5.28 | 1 |
| Gene B | SGN001954 | 7.95 | 1 |
| Gene B | SGN001955 | 7.83 | 1 |
| Gene B | SGN001956 | 4.78 | 1 |
| Gene B | SGN001959 | 1.43 | 1 |
| Gene B | SGN001960 | 17.4 | 1 |
| Gene B | SGN001961 | 1.46 | 1 |
| Gene B | SGN001962 | 1.62 | 1 |
| Gene B | SGN001963 | 11.31 | 1 |
| Gene B | SGN001964 | 2.03 | 1 |
| Gene B | SGN001965 | 9.3 | 1 |
| Gene B | SGN001966 | 1.51 | 1 |
| CFTR | SGN001101 | 17.06 | 1 |
| Gene D | SGN001196 | 14.58 | 1 |
| Gene D | SGN001199 | 42.05 | 1 |
| Gene E | SGN001681 | 48.85 | 1 |
| Gene F | SGN000169 | 55.13 | 2 |
| Gene F | SGN000173 | 47.13 | 1 |
| Gene G | SGN000412 | 16.58 | 1 |
| Gene G | SGN000414 | 14.5 | 2 |
| Gene G | SGN001259 | 24.16 | 1 |
| Gene G | SGN001274 | 10.45 | 2 |
| Gene G | SGN001275 | 5.25 | 1 |
| Gene H | SGN000186 | 32.65 | 1 |
| Gene I | SGN000754 | 30.76 | 1 |
| Gene I | SGN000909 | 21.57 | 2 |
| Gene I | SGN000927 | 3.8 | 1 |
| Gene I | SGN000928 | 28.77 | 1 |
| Gene I | SGN000929 | 17.58 | 2 |
| Gene I | SGN000949 | 26.43 | 1 |
| Gene I | SGN001268 | 16.64 | 2 |
| Gene I | SGN001269 | 6.42 | 1 |
| Gene I | SGN001967 | 1.45 | 1 |
| Gene I | SGN001968 | 5.61 | 1 |
| Gene I | SGN001973 | 5.14 | 1 |
| Gene I | SGN001975 | 0.16 | 1 |
| Gene I | SGN001976 | 0.62 | 1 |
| Gene I | SGN001977 | 0.65 | 1 |
| Gene I | SGN001978 | 3.09 | 1 |
| Gene I | SGN001981 | 2.34 | 1 |

LPG50148-nAPG07433.1 shows editing at many different guides across the genome.

Table 29 shows the editing rates of adenine bases in each guide from LPG50148-nAPG07433.1. Only the adenine positions are shown below. The rate of adenine conversion is the average of multiple experiments when appropriate.

TABLE 29

Editing rate of A nucleotides in mammalian cells for top 10 guides

| SGN | A1 | A3 | A4 | A5 | A6 | A7 | A8 | A9 | A10 | A11 | A13 | A14 |
|---|---|---|---|---|---|---|---|---|---|---|---|---|
| SGN001681 | | | | 13 | | | | | 47 | | | |
| SGN000169 | | | 0.2 | | 1.3 | 17 | | | | 22 | | |
| SGN001199 | | | | 3.5 | | | | | | | 42 | |
| SGN000186 | | | | | | | 24 | | | | | |
| SGN000754 | | | 0 | | 0 | | | 1.3 | | | | 6.1 |
| SGN000143 | 0 | 0 | | 0.4 | | | | 4.4 | | 27 | | 17 |
| SGN000928 | 0.3 | | 0.2 | 0.3 | | 6.1 | | | | | | |
| SGN000487 | 0.2 | 0.2 | | | | | | | 12 | | | 25 |
| SGN001259 | | 0 | | | | | | | 12 | | | |
| SGN001062 | | 0 | | 0.7 | | | 0 | | | | | |

| SGN | A15 | A16 | A17 | A18 | A19 | A20 | A21 | A22 | A24 | A25 |
|---|---|---|---|---|---|---|---|---|---|---|
| SGN001681 | | | | | | | | | | |
| SGN000169 | | | 43 | | 11 | | | 1.7 | | |
| SGN001199 | | | | | | | | | | |
| SGN000186 | | 29 | | 4.1 | | | | 0.2 | | 0.4 |
| SGN000754 | | | 29 | | | | | | | |
| SGN000143 | | | | | 0.3 | | | | | |
| SGN000928 | | | | 26 | | | | | | |
| SGN000487 | | 8.7 | | 7.6 | | | 14 | | | |
| SGN001259 | | | 16 | | | | | | 1 | |
| SGN001062 | 10 | | | 5.8 | | 13 | | 2.4 | 0.1 | 0 |

LPG50148-nAPG07433.1 shows adenine base editing in positions 6 through 21 in the target region depending on the guide RNA used. Editing rates vary by guide RNAs used.

Example 4: Correction of Class I Cystic Fibrosis Nonsense Mutations

Example 4.1: Identification of RGNs and Guide RNAs

Cystic fibrosis is generally caused by deleterious mutations in the CFTR gene (SEQ ID NO: 51). Six of the most common nonsense mutations are G542X, W1282X, R553X, R1162X, E60X, R785X, and Q493X. Each of these stop mutations could be edited to restore a coding codon by an RGN-deaminase fusion protein described herein. To target each mutation, the following must be determined: 1) an RGN which has a PAM recognition site proximal to the nonsense mutation; and 2) a guide RNA which optimally targets the RGN-deaminase fusion protein to the target DNA. Table 30 below shows nickase variants of RGNs which possess PAMs that are proximal to each of the six nonsense mutations and the number of guide RNAs which can be used for each RGN. Table 31 describes the genetic loci for each guide RNA. The PAM recognition site for each genetic locus is underlined. The target sequence for the guide RNA and the guide RNA sequence itself are also indicated.

TABLE 30

RGN nickases and number of guide RNAs for nonsense mutations in CFTR

| RGN nickase | SEQ ID NO. for RGN nickase | E60X | G542X | Q493X | R1162X | R553X | W1282X |
|---|---|---|---|---|---|---|---|
| nAPG00969 | 52 | 2 | | 2 | 2 | | |
| nAPG07433.1 | 42 | 1 | | | | 3 | 1 |
| nAPG06646 | 53 | 6 | 4 | 2 | 3 | 7 | 4 |
| nAPG09748 | 54 | 1 | 1 | 4 | | | 1 |
| nAPG09882 | 55 | 4 | 3 | 5 | 5 | 3 | 5 |
| nAPG03850 | 56 | 2 | 2 | 1 | 3 | 3 | 4 |
| nAPG07553 | 57 | 1 | 1 | 1 | 1 | 1 | 2 |
| nAPG05586 | 58 | 1 | 1 | | 3 | | 1 |
| nAPG01604 | 59 | | | 2 | 1 | | 2 |

TABLE 31 guide RNAs for nonsense mutations in CFTR

| Guide ID | Genetic locus | Genetic locus (SEQ ID NO.) | Target (SEQ ID NO.) | gRNA (SEQ ID NO.) |
|---|---|---|---|---|
| E60X nAPG06646 Target 1 | AATGAGTTTAGGATTTTTCTTTGAAGCCAGCTATCTATCCCATTCTCTGCAAAAG AATAAAAAGT | 62 | 80 | 98 |
| E60X nAPG06646 Target 2 | ATTAATGAGTTTAGGATTTTTCTTTGAAGCCAGCTATCTATCCCATTCTCTGCAA AAGAATAAAA | 63 | 81 | 99 |
| E60X nAPG06646 Target 3 | GCATTAATGAGTTTAGGATTTTTCTTTGAAGCCAGCTATCTATCCCATTCTCTGC AAAAGAATAA | 64 | 82 | 100 |
| E60X nAPG06646 Target 4 | AAGGGCATTAATGAGTTTAGGATTTTTCTTTGAAGCCAGCTATCTATCCCATTCT CTGCAAAAGA | 65 | 83 | 101 |
| E60X nAPG06646 Target 5 | GAAGGGCATTAATGAGTTTAGGATTTTTCTTTGAAGCCAGCTATCTATCCCATTC TCTGCAAAAG | 66 | 84 | 102 |
| E60X nAPG06646 Target 6 | CGAAGGGCATTAATGAGTTTAGGATTTTTCTTTGAAGCCAGCTATCTATCCCATT CTCTGCAAAA | 67 | 85 | 103 |
| E60X nAPG09882 Target 1 | GAGTTTAGGATTTTTCTTTGAAGCCAGCTATCTATCCCATTCTCTGCAAAAGAAT AAAAAGTGGG | 68 | 86 | 104 |
| E60X nAPG09882 Target 2 | TGAGTTTAGGATTTTTCTTTGAAGCCAGCTATCTATCCCATTCTCTGCAAAAGAA TAAAAAGTGG | 69 | 87 | 105 |
| E60X nAPG09882 Target 3 | ATGAGTTTAGGATTTTTCTTTGAAGCCAGCTATCTATCCCATTCTCTGCAAAAGA ATAAAAAGTG | 70 | 88 | 106 |
| E60X nAPG09882 Target 4 | AGGGCATTAATGAGTTTAGGATTTTTCTTTGAAGCCAGCTATCTATCCCATTCTC TGCAAAAGAA | 71 | 89 | 107 |
| E60X nAPG00969 Target 1 | GTTTAGGATTTTTCTTTGAAGCCAGCTATCTATCCCATTCTCTGCAAAAGAATAA AAAGTGGGAC | 72 | 90 | 108 |
| E60X nAPG00969 Target 2 | AGTTTAGGATTTTTCTTTGAAGCCAGCTATCTATCCCATTCTCTGCAAAAGAATA AAAGTGGGA | 73 | 91 | 109 |
| E60X nAPG03850 Target 1 | GGATTTTTCTTTGAAGCCAGCTATCTATCCCATTCTCTGCAAAAGAATAAAAAGT GGGAC | 74 | 92 | 110 |
| E60X nAPG03850 Target 2 | AGTTTAGGATTTTTCTTTGAAGCCAGCTATCTATCCCATTCTCTGCAAAAGAATA AAAG | 75 | 93 | 111 |
| E60X nAPG07433.1 Target 1 | GAAGGGCATTAATGAGTTTAGGATTTTTCTTTGAAGCCAGCTATCTATCCCATTC TCTGCAAAAG | 76 | 94 | 112 |
| E60X nAPG09748 Target 1 | GTCCCACTTTTTATTCTTTTGCAGAGAATGGGATAGATAGCTGGCTTCAAAGAAA AATCC | 77 | 95 | 113 |
| E60X nAPG07553 Target 1 | AGTTTAGGATTTTTCTTTGAAGCCAGCTATCTATCCCATTCTCTGCAAAAGAATA AAAG | 78 | 96 | 114 |
| E60X nAPG05586 Target 1 | TTTAGGATTTTTCTTTGAAGCCAGCTATCTATCCCATTCTCTGCAAAAGAATAAA AAGTG | 79 | 97 | 115 |
| G542X nAPG06646 Target 1 | CGTTGACCTCCACTCAGTGTGATTCCACCTTCTCAAAGAACTATATTGTCTTTCT CTGCAAACTT | 116 | 128 | 140 |
| G542X nAPG06646 Target 2 | GACCTCCACTCAGTGTGATTCCACCTTCTCAAAGAACTATATTGTCTTTCTCTGC AAACTTGGAG | 117 | 129 | 141 |
| G542X nAPG06646 Target 3 | CCTCCACTCAGTGTGATTCCACCTTCTCAAAGAACTATATTGTCTTTCTCTGCAA ACTTGGAGAT | 118 | 130 | 142 |
| G542X nAPG06646 Target 4 | CCACTCAGTGTGATTCCACCTTCTCAAAGAACTATATTGTCTTTCTCTGCAAACT TGGAGATGTC | 119 | 131 | 143 |
| G542X nAPG09882 Target 1 | TCTTGCTCGTTGACCTCCACTCAGTGTGATTCCACCTTCTCAAAGAACTATATTG TCTTTCTCTG | 120 | 132 | 144 |
| G542X nAPG09882 Target 2 | TTGCTCGTTGACCTCCACTCAGTGTGATTCCACCTTCTCAAAGAACTATATTGTC TTTCTCTGCA | 121 | 133 | 145 |

TABLE 31-continued guide RNAs for nonsense mutations in CFTR

| Guide ID | Genetic locus | Genetic locus (SEQ ID NO.) | Target (SEQ ID NO.) | gRNA (SEQ ID NO.) |
|---|---|---|---|---|
| G542X nAPG09882 Target 3 | CACTCAGTGTGATTCCACCTTCTCAAAGAACTATATTGTCTTTCTCTGCAAACTTGGAGATGTCC | 122 | 134 | 146 |
| G542X nAPG03850 Target 1 | TGACCTCCACTCAGTGTGATTCCACCTTCTCAAAGAACTATATTGTCTTTCTCTGCAAAC | 123 | 135 | 147 |
| G542X nAPG03850 Target 2 | TCAGTGTGATTCCACCTTCTCAAAGAACTATATTGTCTTTCTCTGCAAACTTGGAGATGT | 124 | 136 | 148 |
| G542X nAPG09748 Target 1 | AGAGAAAGACAATATAGTTCTTTGAGAAGGTGGAATCACACTGAGTGGAGGTCAACGAGC | 125 | 137 | 149 |
| G542X nAPG07553 Target 1 | TCAGTGTGATTCCACCTTCTCAAAGAACTATATTGTCTTTCTCTGCAAACTTGGAGATGT | 126 | 138 | 150 |
| G542X nAPG05586 Target 1 | CGTTGACCTCCACTCAGTGTGATTCCACCTTCTCAAAGAACTATATTGTCTTTCTCTGCA | 127 | 139 | 151 |
| Q493X nAPG09882 Target 1 | GATATTTTCTTTAATGGTGCCAGGCATAATCCAGGAAAACTAAGAACAGAATGAAATTCTTCCAC | 152 | 169 | 186 |
| Q493X nAPG09882 Target 2 | ATATTTTCTTTAATGGTGCCAGGCATAATCCAGGAAAACTAAGAACAGAATGAAATTCTTCCACT | 153 | 170 | 187 |
| Q493X nAPG09882 Target 3 | TTTTCTTTAATGGTGCCAGGCATAATCCAGGAAAACTAAGAACAGAATGAAATTCTTCCACTGTG | 154 | 171 | 188 |
| Q493X nAPG09882 Target 4 | TTTCTTTAATGGTGCCAGGCATAATCCAGGAAAACTAAGAACAGAATGAAATTCTTCCACTGTGC | 155 | 172 | 189 |
| Q493X nAPG09882 Target 5 | TTCTTTAATGGTGCCAGGCATAATCCAGGAAAACTAAGAACAGAATGAAATTCTTCCACTGTGCT | 156 | 173 | 190 |
| Q493X nAPG09748 Target 1 | TAAGCACAGTGGAAGAATTTCATTCTGTTCTTAGTTTTCCTGGATTATGCCTGGCACCAT | 157 | 174 | 191 |
| Q493X nAPG09748 Target 2 | AAGCACAGTGGAAGAATTTCATTCTGTTCTTAGTTTTCCTGGATTATGCCTGGCACCATT | 158 | 175 | 192 |
| Q493X nAPG09748 Target 3 | ACAGTGGAAGAATTTCATTCTGTTCTTAGTTTTCCTGGATTATGCCTGGCACCATTAAAG | 159 | 176 | 193 |
| Q493X nAPG09748 Target 4 | GGAAGAATTTCATTCTGTTCTTAGTTTTCCTGGATTATGCCTGGCACCATTAAAGAAAAT | 160 | 177 | 194 |
| Q493X nAPG00969 Target 1 | GATATTTTCTTTAATGGTGCCAGGCATAATCCAGGAAAACTAAGAACAGAATGAAATTCTTCCAC | 161 | 178 | 195 |
| Q493X nAPG00969 Target 2 | TTCTTTAATGGTGCCAGGCATAATCCAGGAAAACTAAGAACAGAATGAAATTCTTCCACTGTGCT | 162 | 179 | 196 |
| Q493X nAPG06646 Target 1 | TTTAATGGTGCCAGGCATAATCCAGGAAAACTAAGAACAGAATGAAATTCTTCCACTGTGCTTAA | 163 | 180 | 197 |
| Q493X nAPG06646 Target 2 | AATGGTGCCAGGCATAATCCAGGAAAACTAAGAACAGAATGAAATTCTTCCACTGTGCTTAATTT | 164 | 181 | 198 |
| Q493X nAPG01604 Target 1 | TTCTTTAATGGTGCCAGGCATAATCCAGGAAAACTAAGAACAGAATGAAATTCTTCCACT | 165 | 182 | 199 |
| Q493X nAPG01604 Target 2 | TTAATGGTGCCAGGCATAATCCAGGAAAACTAAGAACAGAATGAAATTCTTCCACTGTGC | 166 | 183 | 200 |
| Q493X nAPG03850 Target 1 | CTTTAATGGTGCCAGGCATAATCCAGGAAAACTAAGAACAGAATGAAATTCTTCCACTGT | 167 | 184 | 201 |
| Q493X nAPG07553 Target 1 | CTTTAATGGTGCCAGGCATAATCCAGGAAAACTAAGAACAGAATGAAATTCTTCCACTGT | 168 | 185 | 202 |
| R553X nAPG06646 Target 1 | CCAATAATTAGTTATTCACCTTGCTAAAGAAATTCTTGCTCATTGACCTCCACTCAGTGTGATTC | 203 | 219 | 235 |

TABLE 31-continued guide RNAs for nonsense mutations in CFTR

| Guide ID | Genetic locus | Genetic locus (SEQ ID NO.) | Target (SEQ ID NO.) | gRNA (SEQ ID NO.) |
|---|---|---|---|---|
| R553X nAPG06646 Target 2 | CAATAATTAGTTATTCACCTTGCTAAAGAAATTCTTGCTCATTGA<u>CCTCCACTCA</u>GTGTGATTCC | 204 | 220 | 236 |
| R553X nAPG06646 Target 3 | ATAATTAGTTATTCACCTTGCTAAAGAAATTCTTGCTCATTGACC<u>TCCACTCAGT</u>GTGATTCCAC | 205 | 221 | 237 |
| R553X nAPG06646 Target 4 | AATTAGTTATTCACCTTGCTAAAGAAATTCTTGCTCATTGACCTCC<u>ACTCAGT</u>GTGATTCCACCT | 206 | 222 | 238 |
| R553X nAPG06646 Target 5 | TCACCTTGCTAAAGAAATTCTTGCTCATTGACCTCCACTCAGTGT<u>GATTCCACCT</u>TCTCCAAGAA | 207 | 223 | 239 |
| R553X nAPG06646 Target 6 | CACCTTGCTAAAGAAATTCTTGCTCATTGACCTCCACTCAGTGTG<u>ATTCCACCTT</u>CTCCAAGAAC | 208 | 224 | 240 |
| R553X nAPG06646 Target 7 | CCTTGCTAAAGAAATTCTTGCTCATTGACCTCCACTCAGTGTGATT<u>CCACCTTCT</u>CCAAGAACTA | 209 | 225 | 241 |
| R553X nAPG07433.1 Target 1 | CCAATAATTAGTTATTCACCTTGCTAAAGAAATTCTTGCTCATTGA<u>CCTCCACTC</u>AGTGTGATTC | 210 | 226 | 242 |
| R553X nAPG07433.1 Target 2 | TCACCTTGCTAAAGAAATTCTTGCTCATTGACCTCCACTCAGTGT<u>GATTCCACCT</u>TCTCCAAGAA | 211 | 227 | 243 |
| R553X nAPG07433.1 Target 3 | CCTTGCTAAAGAAATTCTTGCTCATTGACCTCCACTCAGTGTGATT<u>CCACCTTCT</u>CCAAGAACTA | 212 | 228 | 244 |
| R553X nAPG09882 Target 1 | AATAATTAGTTATTCACCTTGCTAAAGAAATTCTTGCTCATTGACC<u>TCCACTCAG</u>TGTGATTCCA | 213 | 229 | 245 |
| R553X nAPG09882 Target 2 | ATTAGTTATTCACCTTGCTAAAGAAATTCTTGCTCATTGACCTCC<u>ACTCAGTGTG</u>ATTCCACCTT | 214 | 230 | 246 |
| R553X nAPG09882 Target 3 | TATTCACCTTGCTAAAGAAATTCTTGCTCATTGACCTCCACTCAG<u>TGTGATTCCA</u>CCTTCTCCAA | 215 | 231 | 247 |
| R553X nAPG03850 Target 1 | TATTCACCTTGCTAAAGAAATTCTTGCTCATTGACCTCCA<u>CTCAGTGTGA</u>TTCCACCTTC | 216 | 232 | 248 |
| R553X nAPG03850 Target 2 | TTCACCTTGCTAAAGAAATTCTTGCTCATTGACCTCCACT<u>CAGTGTGA</u>TTCCACCTTCTC | 217 | 233 | 249 |
| R553X nAPG03850 Target 3 | CACCTTGCTAAAGAAATTCTTGCTCATTGACCTCCACTCAGT<u>GTGATTCCA</u>CCTTCTCCA | 218 | 234 | 250 |
| R1162X nAPG09882 Target 1 | GGTTTACCTTCTGTTGGCATGTCAATGAACTTAAAGACTCAGCTC<u>ACAGATCGCA</u>TCTGAAATAA | 251 | 269 | 287 |
| R1162X nAPG09882 Target 2 | ACCTTCTGTTGGCATGTCAATGAACTTAAAGACTCAGCTCACAGAT<u>CGCATCTGA</u>AATAAAAATA | 252 | 270 | 288 |
| R1162X nAPG09882 Target 3 | CTGTTGGCATGTCAATGAACTTAAAGACTCAGCTCACAGATCGCAT<u>CTGAAATAA</u>AAATAACAAC | 253 | 271 | 289 |
| R1162X nAPG09882 Target 4 | TGTTGGCATGTCAATGAACTTAAAGACTCAGCTCACAGATCGCATC<u>TGAAATAAA</u>AATAACAACA | 254 | 272 | 290 |
| R1162X nAPG09882 Target 5 | GTTGGCATGTCAATGAACTTAAAGACTCAGCTCACAGATCGCATC<u>TGAAATAAAA</u>ATAACAACAT | 255 | 273 | 291 |
| R1162X nAPG06646 Target 1 | TTTACCTTCTGTTGGCATGTCAATGAACTTAAAGACTCAGCTCAC<u>AGATCGCATC</u>TGAAATAAAA | 256 | 274 | 292 |
| R1162X nAPG06646 Target 2 | TACCTTCTGTTGGCATGTCAATGAACTTAAAGACTCAGCTCACAG<u>ATCGCATCTG</u>AAATAAAAAT | 257 | 275 | 293 |
| R1162X nAPG06646 Target 3 | TGGCATGTCAATGAACTTAAAGACTCAGCTCACAGATC<u>GCATCTG</u>AAATAAAAATAACAA | 258 | 276 | 294 |
| R1162X nAPG03850 Target 1 | TACCTTCTGTTGGCATGTCAATGAACTTAAAGACTCAGCTC<u>ACAGATCGCATCTG</u>AAATA | 259 | 277 | 295 |

TABLE 31-continued quide RNAs for nonsense mutations in CFTR

| Guide ID | Genetic locus | Genetic locus (SEQ ID NO.) | Target (SEQ ID NO.) | gRNA (SEQ ID NO.) |
|---|---|---|---|---|
| R1162X nAPG03850 Target 2 | TTCTGTTGGCATGTCAATGAACTTAAAGACTCAGCTCACAGATCGCATCTGAAAT AAAAA | 260 | 278 | 296 |
| R1162X nAPG03850 Target 3 | TGGCATGTCAATGAACTTAAAGACTCAGCTCACAGATCGCATCTGAAATAAAAAT AACAA | 261 | 279 | 297 |
| R1162X nAPG05586 Target 1 | TTACCTTCTGTTGGCATGTCAATGAACTTAAAGACTCAGCTCACAGATCGCATCT GAAAT | 262 | 280 | 298 |
| R1162X nAPG05586 Target 2 | CTGTTGGCATGTCAATGAACTTAAAGACTCAGCTCACAGATCGCATCTGAAATAA AAATA | 263 | 281 | 299 |
| R1162X nAPG05586 Target 3 | TGTCAATGAACTTAAAGACTCAGCTCACAGATCGCATCTGAAATAAAAATAACAA CATTT | 264 | 282 | 300 |
| R1162X nAPG00969 Target 1 | GGTTTACCTTCTGTTGGCATGTCAATGAACTTAAAGACTCAGCTCACAGATCGCA TCTGAAATAA | 265 | 283 | 301 |
| R1162X nAPG00969 Target 2 | GTTGGCATGTCAATGAACTTAAAGACTCAGCTCACAGATCGCATCTGAAATAAAA ATAACAACAT | 266 | 284 | 302 |
| R1162X nAPG07553 Target 1 | TGGCATGTCAATGAACTTAAAGACTCAGCTCACAGATCGCATCTGAAATAAAAAT AACAA | 267 | 285 | 303 |
| R1162X nAPG01604 Target 1 | GCATGTCAATGAACTTAAAGACTCAGCTCACAGATCGCATCTGAAATAAAAATAA CAACA | 268 | 286 | 304 |
| W1282X nAPG09882 Target 1 | GTGTGTCTTGGGATTCAATAACTTTGCAACAGTGAAGGAAAGCCTTTGGAGTGAT ACCACAGGTG | 305 | 325 | 345 |
| W1282X nAPG09882 Target 2 | GTCTTGGGATTCAATAACTTTGCAACAGTGAAGGAAAGCCTTTGGAGTGATACCA CAGGTGAGCA | 306 | 326 | 346 |
| W1282X nAPG09882 Target 3 | CTTGGGATTCAATAACTTTGCAACAGTGAAGGAAAGCCTTTGGAGTGATACCACA GGTGAGCAAA | 307 | 327 | 347 |
| W1282X nAPG09882 Target 4 | GGGATTCAATAACTTTGCAACAGTGAAGGAAAGCCTTTGGAGTGATACCACAGGT GAGCAAAAGG | 308 | 328 | 348 |
| W1282X nAPG09882 Target 5 | GATTCAATAACTTTGCAACAGTGAAGGAAAGCCTTTGGAGTGATACCACAGGTGA GCAAAAGGAC | 309 | 329 | 349 |
| W1282X nAPG06646 Target 1 | TCGATGGTGTGTCTTGGGATTCAATAACTTTGCAACAGTGAAGGAAAGCCTTTGG AGTGATACCA | 310 | 330 | 350 |
| W1282X nAPG06646 Target 2 | TTGGGATTCAATAACTTTGCAACAGTGAAGGAAAGCCTTTGGAGTGATACCACAG GTGAGCAAAA | 311 | 331 | 351 |
| W1282X nAPG06646 Target 3 | TGGGATTCAATAACTTTGCAACAGTGAAGGAAAGCCTTTGGAGTGATACCACAGG TGAGCAAAAG | 312 | 332 | 352 |
| W1282X nAPG06646 Target 4 | GGATTCAATAACTTTGCAACAGTGAAGGAAAGCCTTTGGAGTGATACCACAGGTG AGCAAAAGGA | 313 | 333 | 353 |
| W1282X nAPG03850 Target 1 | TGTCTTGGGATTCAATAACTTTGCAACAGTGAAGGAAAGCCTTTGGAGTGATACC ACAGG | 314 | 334 | 354 |
| W1282X nAPG03850 Target 2 | GTCTTGGGATTCAATAACTTTGCAACAGTGAAGGAAAGCCTTTGGAGTGATACCA CAGGT | 315 | 335 | 355 |
| W1282X nAPG03850 Target 3 | CTTGGGATTCAATAACTTTGCAACAGTGAAGGAAAGCCTTTGGAGTGATACCACA GGTGA | 316 | 336 | 356 |
| W1282X nAPG03850 Target 4 | TGGGATTCAATAACTTTGCAACAGTGAAGGAAAGCCTTTGGAGTGATACCACAGG TGAGC | 317 | 337 | 357 |
| W1282X nAPG07553 Target 1 | CTTGGGATTCAATAACTTTGCAACAGTGAAGGAAAGCCTTTGGAGTGATACCACA GGTGA | 318 | 338 | 358 |
| W1282X nAPG07553 Target 2 | TGGGATTCAATAACTTTGCAACAGTGAAGGAAAGCCTTTGGAGTGATACCACAGG TGAGC | 319 | 339 | 359 |

TABLE 31-continued guide RNAs for nonsense mutations in CFTR

| Guide ID | Genetic locus | Genetic locus (SEQ ID NO.) | Target (SEQ ID NO.) | gRNA (SEQ ID NO.) |
|---|---|---|---|---|
| W1282X nAPG01604 Target 1 | TCTTGGGATTCAATAACTTTGCAACAGTGAAGGAAAGCCTTTGGAGTGATACCAC AGGTG | 320 | 340 | 360 |
| W1282X nAPG01604 Target 2 | CTTGGGATTCAATAACTTTGCAACAGTGAAGGAAAGCCTTTGGAGTGATACCACA GGTGA | 321 | 341 | 361 |
| W1282X nAPG07433.1 Target 1 | TTGGGATTCAATAACTTTGCAACAGTGAAGGAAAGCCTTTGGAGTGATACCACAG GTGAGCAAAA | 322 | 342 | 362 |
| W1282X nAPG09748 Target 1 | GTATCACTCCAAAGGCTTTCCTTCACTGTTGCAAAGTTATTGAATCCCAAGACAC ACCAT | 323 | 343 | 363 |
| W1282X nAPG05586 Target 1 | GATTCAATAACTTTGCAACAGTGAAGGAAAGCCTTTGGAGTGATACCACAGGTGA GCAAA | 324 | 344 | 364 |
| F508de nAPG07433.1 SGN001101 Target1 | ACCAAAGATGATATTTTCTTTAATGGTGCCAGGCATAATCCAGGAAAACTGAGAA CAGAATGAAA | 562 | 563 | 564 |

Table 28 in Example 3 provides editing data for the SGN001101 sgRNA targeting CFTR.

To assay for activity of the other guide RNAs, a guide RNA of Table 31 is provided with the corresponding nickase variant of each RGN described in Table 30, which is operably linked to a deaminase of the invention to produce a fusion protein. It is recognized that nuclease inactive variants of each RGN may be tested similarly as well. Each guide and fusion protein combination is assayed for the ability to edit at the target location in 16HBE14o− immortalized bronchial epithelial cells. Currently, three HBE cell lines containing the CFTR nonsense mutations are available (Cystic Fibrosis Foundation, Lexington, MA). These cell lines are used to assay the G542X, W1282X, and R1162X nonsense mutation targets and compared to the 16HBE14o− line. The fusion protein and guide RNA is delivered to the cells as ribonucleoproteins (RNPs), which are nucleofected into the 16HBE14o− cell line following culturing and transformation methods provided in Valley et al (Valley et al, 2019. *J Cyst Fibros* 18, 476-483, incorporated by reference herein). The guide RNA is provided as a single guide RNA or as a 1:1 or 1:1.2 molar ratio of tracrRNA:crRNA duplex with RGN proteins. Nucleofection of RNPs into cells is performed on a Lonza 4D-Nucleofector. Cells are then incubated at 37° C. for 72 h. In some embodiments, the fusion protein and gRNA are delivered to the cells as RNA molecules, with the fusion protein encoded in an mRNA.

Because there are no cell lines available for the E60X, R553X, and Q493X, these mutations are assayed in HEK293 cells using a modification of the GFP restoration assay described in Example 2, where the mutant locus containing the nonsense mutation is cloned into the GFP reading frame 2.

Following incubation, genomic DNA is then extracted using NucleoSpin 96 Tissue (Macherey-Nagel) following the manufacturer's protocol. The genomic region flanking the targeted genomic site is PCR amplified and products are purified using ZR-96 DNA Clean and Concentrator (Zymo Research) following the manufacturer's protocol. The purified PCR products are then sent for Next Generation Sequencing on Illumina MiSeq. Typically, 100,000 of 250 bp paired-end reads (2×100,000 reads) are generated per amplicon. The reads are analyzed using CRISPResso (Pinello, et al. 2016) to calculate the rates of editing. Output alignments are hand-curated to confirm introduction of the base-edited mutations of interest and also to screen for undesirable INDEL formation.

In addition to efficiency of base editing, the protein product of the base-edited CFTR gene is evaluated for function. For two of the nonsense mutations, Glu60X and Gly542X, the base edited change of adenine to guanine does not restore the wildtype sequence, as these mutations are caused by guanine to thymine transversions. The targeted activity of the fusion protein changes the Glu60X to Glu60Gln and Gly452X to Gly542Arg. While these mutations do allow for a full-length protein to be made, the stability and functionality of the CFTR protein is also confirmed.

Example 4.2: Engineering RGNs for Decreased Size

Ideally, the coding sequence of an RGN-deaminase fusion protein of the invention and a corresponding guide RNA for targeting the fusion protein to the CFTR gene is all packaged into a single AAV vector. The generally accepted size limit for AAV vectors is 4.7 kb, although larger sizes may be contemplated at the expense of reduced packing efficiency. The RGN nickases in Table 30 have a coding sequence length of about 3.15-3.45 kB. To ensure that the expression cassettes for both the fusion protein and its corresponding guide RNA could fit into an AAV vector, shortening the length of RGN amino acid and its corresponding nucleic acid coding sequence is desirable.

Through alignment with closely related homologs, a unique 8 amino acid region at positions 590-597 was identified in APG07433.1 and its close homolog APG08290.1 (described in WO 2019/236566 and set forth herein as SEQ ID NO: 60). This region, set forth as SEQ ID NO: 365 for APG07433.1 and SEQ ID NO: 367 for APG08290.1, was removed from both proteins, resulting in variant RGNs APG07433.1-del (SEQ ID NO: 366) and APG08290.1-del (SEQ ID NO: 368). These deletion variants and their corresponding wild-type RGNs were assayed for editing activity in HEK293T cells using the guide RNAs indicated in Tables 32 and 33 following methods similar to those described in Example 1. Rates of editing of the target sequences are shown in Tables 32 and 33 below.

TABLE 32

Editing Rate for APG07433.1 Protein Deletion Variants

| guide RNA | Target (SEQ ID NO.) | sgRNA (SEQ ID NO.) | APG07433.1 | APG07433.1-del |
|---|---|---|---|---|
| SGN000139 | 369 | 383 | 11.09% | 1.00% |
| SGN000143 | 370 | 384 | 2.68% | 0.71% |
| SGN000169 | 371 | 385 | 13.37% | 15.48% |
| SGN000173 | 372 | 386 | 13.65% | 15.37% |
| SGN000186 | 373 | 387 | 14.72% | 15.16% |
| SGN000194 | 374 | 388 | 11.91% | 7.66% |
| SGN000927 | 376 | 390 | 9.53% | 11.47% |
| SGN000929 | 378 | 392 | 6.14% | 13.10% |
| SGN000930 | 379 | 393 | 7.52% | 9.51% |
| SGN000935 | 381 | 395 | 11.08% | 15.99% |
| SGN001101 | 382 | 396 | 6.16% | 6.75% |

For targets SGN000169, SGN000173, SGN000186, SGN000927, SGN000930, and SGN001101, the editing rate of the wild type APG07433.1 protein and the engineered variant was similar. For targets SGN000139, SGN000143, and SGN000194, the editing rate is decreased when the engineered variant was used compared to the wild type protein. With SGN000929 and SGN000935, the editing rate increased with the engineered APG07433.1 variant compared to the wild type sequence.

TABLE 33

Editing Rate for APG08290.1 Protein Deletion Variants

| sgRNA ID | Target (SEQ ID NO.) | sgRNA (SEQ ID NO.) | APG08290.1 | APG08290.1-del |
|---|---|---|---|---|
| SGN000926 | 375 | 389 | N.D. | 6.47% |
| SGN000929 | 378 | 392 | 1.83% | 0.61% |
| SGN000930 | 379 | 393 | 9.93% | 6.47% |
| SGN000928 | 377 | 391 | N.D. | 0.13% |
| SGN000931 | 380 | 394 | 0% | 0% |

N.D. = Not determined

The APG08290.1 deletion variant showed editing in all samples where the wild type APG08290.1 protein also showed editing. The lowest editing rate detected was 0.13% with the engineered protein. Target SGN000926 showed the highest editing rate: 9.17%.

Fusion proteins comprising APG07433.1-del or APG08290.1-del and a deaminase of the invention are produced and assayed for base editing activity using methods similar to Example 1.

A fusion protein comprises an RGN and a deaminase linked by a flexible peptide linker, such as that set forth as SEQ ID NO: 45. The linker of SEQ ID NO: 45 is 16 amino acids in length; this size may be reduced to reduce the size of the coding sequence of the fusion protein. Peptide linkers of less than 16 amino acids can be produced and operably link RGNs APG07433.1-del or APG08290.1-del and a deaminase of the invention and tested for base editing activity using methods similar to Example 1. Because the peptide linker between the RGN and the deaminase can determine the editing window of the fusion protein, testing of alternative linkers with different lengths and rigidity may also lead to improvements in editing efficiency while reducing off-target mutations. Therefore, fusion proteins with the highest editing rate are then assayed following methods similar to Example 4.1 to determine editing efficiency for each of the CFTR target sequences. Fusion protein-gRNA combinations with the highest editing efficiency are selected as the preferred guide for editing at that location and are used for AAV vector design.

Example 4.3: AAV Delivery

The coding sequences for validated fusion protein/gRNA combinations with the highest editing rate are packaged into AAV vectors. AAV delivery has a number of benefits including a lack of pathogenicity, low immunogenicity, high transduction rates, and a defined path to manufacturing. Also, AAV dosing of the lungs has been shown to be safe and at least to some degree, efficacious with both single and repeat dosing (Guggino et al., 2017, *Expert Opin Biol Ther* 17, 1265-1273). After a fusion protein/gRNA combination has been cloned into an AAV vector, it may be packaged into several different serotypes to optimize tissue specific infectivity. For treatment of CF, the target for base editing is progenitor apical epithelium cells of the lungs, which will allow the correction to persist throughout cell turnover. To target respiratory epithelium, the capsid for serotypes AAV1, AAV5 or AAV6 are utilized, as these serotypes have been shown to have high infectivity in respiratory epithelium cells (Zabner et al., 2000, *J Virol* 74, 3852-3858).

Once the AAV vectors are produced, they are transduced into human airway epithelial cells in culture. The three HBE cell lines containing the CFTR G542X, R1162X, and W1282X nonsense mutation targets are used to validate the constructs for correction of those mutations. The 16HBE14o– line is used to test the constructs correcting the other nonsense mutations. A range of multiplicities of infection (MOIs) are tested. In either case, reversion of the nonsense mutation to the wild type CFTR sequence is assessed. After 2-3 days in culture, genomic DNA is harvested, amplicons around the targeted sites are generated by PCR, and NGS is performed to determine editing rates at each locus similar to the methods described in Example 1. Because airway epithelial cells are used, AAV introduction and editing rates are as similar to an in vivo treatment as possible while using a cultured cell system. AAVs with different serotypes are compared to determine which serotype is optimal for delivery of the fusion protein/gRNA into airway cells. The editing rates achieved by AAV introduction of these systems are compared with the RNP editing rates observed in Example 4.2.

Because cell lines for the nonsense mutations R553X, E60X, and Q493X are not available, fusion protein/gRNA systems targeting these mutations are evaluated in wild type 16HBE14o– cells to assay for AAV introduction, base editor expression, and off-target editing rates at the location of interest. To determine the rate of stop codon correction, the mutant locus is cloned into GFP for a GFP restoration assay as described in Example 4.1.

In parallel with determining editing rates by NGS, total protein lysates from cells harboring CFTR mutations edited with fusion protein/gRNA systems are collected and the levels of full-length CFTR protein assessed by western blotting. To test whether functional CFTR protein is formed, forskolin activation assays are performed using methods similar to those described by Devor et al (2000, *Am J Physiol Cell Physiol* 279, C461-479, incorporated by reference herein) and/or Dousmais et al (2002, *J Gen Physiol* 119, 545-559, incorporated by reference herein). In these experiments, edited CFTR mutant cells are treated with forskolin, an activator of adenylate cyclase, to increase intracellular levels of cAMP. Elevated cAMP levels then activate CFTR, and the influx of Cl⁻ is measured by either a genetically-encoded yellow fluorescent protein based Cl⁻ sensor or a small molecule fluorescent indicator of chloride such as MQAE. The G542X, R1162X, and W1282X edited cell lines are tested in this assay.

To determine the rate of off-target mutations, a bioinformatic approach which is customized with information about the seed region and flexible off-target PAM recognition space of each specific nuclease is used. These pieces of information have been determined bioinformatically for each protein and are used to rank the likelihood of off-target activity for each protein.

To complement bioinformatic prediction of off targets, biochemical detection of off-targets via a modified SITE-seq protocol (Cameron et al., 2017, *Nat Methods* 14, 600-606, herein incorporated by reference) is also performed. Briefly, genomic DNA from human airway epithelial cells is obtained. This DNA is then treated with the RGN of interest at several different concentrations. Any DNA double stranded breaks are labelled, selectively isolated, and PCR amplified with adapter sequences that allow for NGS. Sequencing reads are then mapped to the genome and "pileups" of reads are identified at sites of double stranded breaks, marking putative off target locations. In a subsequent set of experiments, cells are edited with the RGN or RGN-deaminase fusion protein of interest and these putative sites are individually sequenced to confirm if they are bona fide off-targets. Since chromatin context, DNA accessibility, and other factors can impact the efficiency of genome editors in living cells, biochemical methods typically overestimate the number of off-targets. Therefore, both bioinformatic and biochemical methods together provide complementary methods to identify putative off-target sites, but these sites must be verified by amplicon sequencing to get an accurate assessment of off-target editing.

Once putative off-target sites are identified, amplicon sequencing on 16HBE airway epithelial cells edited with the same optimized fusion protein and guide(s) ensures that the off-target profile established for these systems matches the expected profile in patient lungs as closely as possible.

To determine if the fusion proteins described herein induce changes in cellular RNA, careful analysis of the cellular transcriptome following editing is necessary. Fortunately, RNA-seq techniques to assess adenine base-editing off-target effects have become routine (Grunewald et al, 2017, *Nature* 569, 433-437; Zhou et al, *Nature* 571, 275-278, both incorporated by reference herein). Briefly, after editing cells with the fusion protein/gRNA systems determined in Example 4.2, total cellular mRNA is collected and subjected to RNA-seq. Transcriptomes from edited cells are compared to cells transfected with the ABE alone, and significant differences in RNA sequence are identified.

Example 5: Targeted Base-Editing for Correction of Causal Disease Mutations

A database of clinical variants was obtained from NCBI ClinVar database, which is available through the world wide web at the NCBI ClinVar website. Pathogenic Single Nucleotide Polymorphisms (SNPs) were identified from this list. Using the genomic locus information, CRISPR targets in the region overlapping and surrounding each SNP were identified. A selection of SNPs that can be corrected using base editing in combination with an RGN, such as for example an RGN listed in Table 30 or a variant thereof, to target the causal mutation ("Casl Mut.") is listed in Table 34. In Table 34 below, only one alias of each disease is listed. The "RS #" corresponds to the RS accession number through the SNP database at the NCBI website. The "AlleleID" corresponds to a causal allele accession number. The "Name" column contains the genetic locus identifier, the gene name, the location of the mutation in the gene, and the change resulting from the mutation.

TABLE 34

Disease Targets for Base Editing

| RS# | AlleleID | Name | GeneSymbol |
|---|---|---|---|
| 36053993 | 20333 | NM_001128425.1(MUTYH): c.1187G > A (p.Gly396Asp) | MUTYH |
| 41293455 | 32714 | NM_007294.3(BRCA1): c.4327C > T (p.Arg1443Ter) | BRCA1 |
| 62625308 | 32710 | NM_007294.3(BRCA1): c.3607C > T (p.Arg1203Ter) | BRCA1 |
| 41293465 | 70268 | NM_007294.3(BRCA1): c.5503C > T (p.Arg1835Ter) | BRCA1 |
| 80357123 | 70147 | NM_007294.3(BRCA1): c.5251C > T (p.Arg1751Ter) | BRCA1 |
| 137929307 | 171217 | NM_000527.4(LDLR): c.1775G > A (p.Gly592Glu) | LDLR |
| 80356898 | 45982 | NM_007294.3(BRCA1): c.1687C > T (p.Gln563Ter) | BRCA1 |
| 28936415 | 22745 | NM_000303.2(PMM2): c.422G > A (p.Arg141His) | PMM2 |
| 11555217 | 34125 | NM_001360.2(DHCR7): c.452G > A (p.Trp151Ter) | DHCR7 |
| 55770810 | 70063 | NM_007294.3(BRCA1): c.5095C > T (p.Arg1699Trp) | BRCA1 |
| 28934906 | 26850 | NM_004992.3(MECP2): c.473C > T (p.Thr158Met) | MECP2 |
| 28929474 | 33006 | NM_001127701.1(SERPINA1): c.1096G > A (p.Glu366Lys) | SERPINA1 |
| 371898076 | 52045 | NM_000257.4(MYH7): c.1988G > A (p.Arg663His) | MYH7 |
| 5030858 | 15616 | NM_000277.3(PAH): c.1222C > T (p.Arg408Trp) | PAH |
| 80356945 | 69207 | NM_007294.3(BRCA1): c.2338C > T (p.Gln780Ter) | BRCA1 |
| 1800553 | 22927 | NM_000350.2(ABCA4): c.5882G > A (p.Gly1961Glu) | ABCA4 |
| 80356962 | 70247 | NM_007294.3(BRCA1): c.5444G > A (p.Trp1815Ter) | BRCA1 |
| 104894396 | 32041 | NM_004004.6(GJB2): c.71G > A (p.Trp24Ter) | GJB2 |
| 113994095 | 28535 | NM_002693.2(POLG): c.1399G > A (p.Ala467Thr) | POLG |
| 61749721 | 26868 | NM_004992.3(MECP2): c.763C > T (p.Arg255Ter) | MECP2 |
| 137852700 | 23943 | NM_000310.3(PPT1): c.451C > T (p.Arg151Ter) | PPT1 |
| 75527207 | 22159 | NM_000492.3(CFTR): c.1652G > A (p.Gly551Asp) | CFTR |
| 78655421 | 22148 | NM_000492.3(CFTR): c.350G > A (p.Arg117His) | CFTR |
| 80356885 | 69888 | NM_007294.3(BRCA1): c.4524G > A (p.Trp1508Ter) | BRCA1 |
| 113994098 | 28541 | NM_002693.2(POLG): c.2542G > A (p.Gly848Ser) | POLG |
| 61750240 | 26854 | NM_004992.3(MECP2): c.808C > T (p.Arg270Ter) | MECP2 |
| 61751362 | 26858 | NM_001110792.1(MECP2): c.916C > T (p.Arg306Ter) | MECP2 |
| 80357260 | 69792 | NM_007294.3(BRCA1): c.4183C > T (p.Gln1395Ter) | BRCA1 |
| 80359071 | 67203 | NM_000059.3(BRCA2): c.8243G > A (p.Gly2748Asp) | BRCA2 |

TABLE 34-continued

Disease Targets for Base Editing

| RS# | AlleleID | Name | GeneSymbol |
|---|---|---|---|
| 62625307 | 69596 | NM_007294.3(BRCA1): c.3598C > T (p.Gln1200Ter) | BRCA1 |
| 76992529 | 28465 | NM_000371.3(TTR): c.424G > A (p.Val142Ile) | TTR |
| 77010898 | 22168 | NM_000492.3(CFTR): c.3846G > A (p.Trp1282Ter) | CFTR |
| 80359003 | 67069 | NM_000059.3(BRCA2): c.7757G > A (p.Trp2586Ter) | BRCA2 |
| 61750420 | 22555 | NM_000466.2(PEX1): c.2528G > A (p.Gly843Asp) | PEX1 |
| 80357284 | 46214 | NM_007294.3(BRCA1): c.5346G > A (p.Trp1782Ter) | BRCA1 |
| 200411226 | 174776 | NM_000256.3(MYBPC3): c.1484G > A (p.Arg495Gln) | MYBPC3 |
| 5030857 | 98638 | NM_000277.3(PAH): c.1208C > T (p.Ala403Val) | PAH |
| 28935468 | 26863 | NM_004992.3(MECP2): c.916C > T (p.Arg306Cys) | MECP2 |
| 62642937 | 15667 | NM_000277.3(PAH): c.1139C > T (p.Thr380Met) | PAH |
| 80356989 | 69812 | NM_007294.3(BRCA1): c.4222C > T (p.Gln1408Ter) | BRCA1 |
| 28942080 | 18735 | NM_000527.4(LDLR): c.1567G > A (p.Val523Met) | LDLR |
| 121908039 | 18778 | NM_000527.4(LDLR): c.551G > A (p.Cys184Tyr) | LDLR |
| 267607213 | 18780 | NM_000527.4(LDLR): c.131G > A (p.Trp44Ter) | LDLR |
| 3218716 | 52071 | NM_000257.3(MYH7): c.2389G > A (p.Ala797Thr) | MYH7 |
| 104895097 | 17588 | NM_000243.2(MEFV): c.2282G > A (p.Arg761His) | MEFV |
| 397516074 | 51962 | NM_000256.3(MYBPC3): c.772G > A (p.Glu258Lys) | MYBPC3 |
| 119455955 | 17682 | NM_000391.3(TPP1): c.622C > T (p.Arg208Ter) | TPP1 |
| 75184679 | 16301 | NM_024570.3(RNASEH2B): c.529G > A (p.Ala177Thr) | RNASEH2B |
| 80338901 | 26909 | NM_000137.2(FAH): c.1062+5G > A | FAH |
| 119450941 | 17501 | NM_000026.3(ADSL): c.1277G > A (p.Arg426His) | ADSL |
| 121965019 | 26947 | NM_000203.4(IDUA): c.1205G > A (p.Trp402Ter) | IDUA |
| 141659620 | 21858 | NM_003119.3(SPG7): c.1045G > A (p.Gly349Ser) | SPG7 |
| 41276738 | 15335 | NM_000552.4(VWF): c.2561G > A (p.Arg854Gln) | VWF |
| 80338940 | 32068 | NM_004004.5(GJB2): c.−23 + 1G > A | GJB2 |
| 80357292 | 46268 | NM_007294.3(BRCA1): c.962G > A (p.Trp321Ter) | BRCA1 |
| 121913627 | 29130 | NM_000257.3(MYH7): c.1816G > A (p.Val606Met) | MYH7 |
| 137854601 | 24416 | NM_198056.2(SCN5A).c.5350G > A (p.Glu1784Lys) | SCN5A |
| 80338933 | 17521 | NM_024577.3(SH3TC2): c.2860C > T (p.Arg954Ter) | SH3TC2 |
| 80338948 | 32048 | NM_004004.5(GJB2): c.427C > T (p.Arg143Trp) | GJB2 |
| 80356903 | 69645 | NM_007294.3(BRCA1): c.3718C > T (p.Gln1240Ter) | BRCA1 |
| 80356969 | 70213 | NM_007294.3(BRCA1): c.5353C > T (p.Gln1785Ter) | BRCA1 |
| 80357010 | 45971 | NM_007294.3(BRCA1): c.1480C > T (p.Gln494Ter) | BRCA1 |
| 116987552 | 17337 | NM_005609.3(PYGM): c.148C > T (p.Arg50Ter) | PYGM |
| 121913625 | 29128 | NM_000257.4(MYH7): c.1357C > T (p.Arg453Cys) | MYH7 |
| 387907267 | 45725 | NM_000256.3(MYBPC3): c.2827C > T (p.Arg943Ter) | MYBPC3 |
| 28934897 | 26968 | NM_000431.3(MVK): c.1129G > A (p.Val377Ile) | MVK |
| 76713772 | 22151 | NM_000492.3(CFTR): c.1585-1G > A | CFTR |
| 137852959 | 19587 | NM_153638.3(PANK2): c.1561G > A (p.Gly521Arg) | PANK2 |
| 199682486 | 101428 | NM_013339.4(ALG6): c.257 + 5G > A | ALG6 |
| 397507389 | 46666 | NM_000059.3(BRCA2): c.7618-1G > A | BRCA2 |
| 769370816 | 228176 | NM_000527.4(LDLR): c.1618G > A (p.Ala540Thr) | LDLR |
| 36211715 | 29159 | NM_000257.4(MYH7): c.2609G > A (p.Arg870His) | MYH7 |
| 76434661 | 53916 | NM_004004.5(GJB2): c.416G > A (p.Ser139Asn) | GJB2 |
| 104894368 | 29104 | NM_000432.3(MYL2): c.64G > A (p.Glu22Lys) | MYL2 |
| 104894635 | 20146 | NM_000199.3(SGSH): c.734G > A (p.Arg245His) | SGSH |
| 121913628 | 29131 | NM_000257.3(MYH7): c.2770G > A (p.Glu924Lys) | MYH7 |
| 193922390 | 45304 | NM_000257.4(MYH7): c.5135G > A (p.Arg1712Gln) | MYH7 |
| 397515757 | 51454 | NM_000138.4(FBN1): c.1468 + 5G > A | FBN1 |
| 11549407 | 30441 | NM_000518.5(HBB): c.118C > T (p.Gln40Ter) | HBB |
| 61751374 | 22933 | NM_000350.2(ABCA4): c.3113C > T (p.Ala1038Val) | ABCA4 |
| 121434420 | 21793 | NM_004572.3(PKP2): c.235C > T (p.Arg79Ter) | PKP2 |
| 137853007 | 20631 | NM_007194.4(CHEK2): c.433C > T (p.Arg145Trp) | CHEK2 |
| 1137887 | 18083 | NM_000051.3(ATM): c.2250G > A (p.Lys750=) | ATM |
| 28934872 | 27436 | NM_000548.3(TSC2): c.1832G > A (p.Arg611Gln) | TSC2 |
| 80224560 | 47062 | NM_000492.3(CFTR): c.2657 + 5G > A | CFTR |
| 80359004 | 46672 | NM_000059.3(BRCA2): c.7758G > A (p.Trp2586Ter) | BRCA2 |
| 121434274 | 18627 | NM_000016.5(ACADM): c.799G > A (p.Gly267Arg) | ACADM |
| 121908529 | 38436 | NM_000030.2(AGXT): c.508G > A (p.Gly170Arg) | AGXT |
| 121918007 | 28709 | NM_000478.4(ALPL): c.571G > A (p.Glu191Lys) | ALPL |
| 121918243 | 16464 | NM_015506.2(MMACHC): c.482G > A (p.Arg161Gln) | MMACHC |
| 397518423 | 94255 | NM_005026.4(PIK3CD): c.3061G > A (p.Glu1021Lys) | PIK3CD |
| 587781629 | 150997 | NM_000059.3(BRCA2): c.1909 + 1G > A | BRCA2 |
| 765696008 | 228162 | NM_000527.4(LDLR): c.1187-10G > A | LDLR |
| 3218713 | 29127 | NM_000257.3(MYH7): c.746G > A (p.Arg249Gln) | MYH7 |
| 5030855 | 15646 | NM_000277.3(PAH): c.1066-11G > A | PAH |
| 55851803 | 69067 | NM_007294.3(BRCA1): c.191G > A (p.Cys64Tyr) | BRCA1 |
| 62508698 | 15619 | NM_000277.1(PAH): c.838G > A (p.Glu280Lys) | PAH |
| 62516152 | 108520 | NM_000277.3(PAH): c.688G > A (p.Val230Ile) | PAH |
| 62644499 | 15656 | NM_000277.3(PAH): c.1243G > A (p.Asp415Asn) | PAH |
| 80338815 | 18090 | NM_000487.5(ARSA): c.465 + 1G > A | ARSA |
| 121908987 | 21885 | NM_016203.3(PRKAG2): c.905G > A (p.Arg302Gln) | PRKAG2 |
| 121964962 | 15156 | NM_000071.2(CBS): c.919G > A (p.Gly307Ser) | CBS |
| 5030851 | 15628 | NM_000277.3(PAH): c.842C > T (p.Pro281Leu) | PAH |
| 63750871 | 24273 | NM_000535.6(PMS2): c.400C > T (p.Arg134Ter) | PMS2 |
| 80338853 | 21822 | NM_001360.2(DHCR7): c.278C > T (p.Thr93Met) | DHCR7 |

TABLE 34-continued

Disease Targets for Base Editing

| RS# | AlleleID | Name | GeneSymbol |
|---|---|---|---|
| 80356893 | 68976 | NM_007294.3(BRCA1): c.1612C > T (p.Gln538Ter) | BRCA1 |
| 80357131 | 46031 | NM_007294.3(BRCA1): c.2563C > T (p.Gln855Ter) | BRCA1 |
| 80357223 | 69350 | NM_007294.3(BRCA1): c.2800C > T (p.Gln934Ter) | BRCA1 |
| 80357318 | 46112 | NM_007294.3(BRCA1): c.3937C > T (p.Gln1313Ter) | BRCA1 |
| 104886457 | 27086 | NM_000136.2(FANCC): c.1642C > T (p.Arg548Ter) | FANCC |
| 137852944 | 19147 | NM_138694.3(PKHD1): c.107C > T (p.Thr36Met) | PKHD1 |
| 180177083 | 132139 | NM_024675.3(PALB2): c.196C > T (p.Gln66Ter) | PALB2 |
| 180177110 | 152117 | NM_024675.3(PALB2): c.2257C > T (p.Arg753Ter) | PALB2 |
| 199475575 | 108459 | NM_000277.3(PAH): c.526C > T (p.Arg176Ter) | PAH |
| 387906843 | 39241 | NM_002878.3(RAD51D): c.556C > T (p.Arg186Ter) | RAD51D |
| 529008617 | 152318 | NM_001128425.1(MUTYH): c.1214C > T (p.Pro405Leu) | MUTYH |
| 587780021 | 133177 | NM_000465.3(BARD1): c.1690OT (p.Gln564Ter) | BARD1 |
| 34637584 | 16979 | NM_198578.3(LRRK2): c.6055G > A (p.Gly2019Ser) | LRRK2 |
| 78802634 | 22233 | NM_000492.3(CFTR): c.3266G > A (p.Trp1089Ter) | CFTR |
| 80358809 | 66611 | NM_000059.3(BRCA2): c.581G > A (p.Trp194Ter) | BRCA2 |
| 80359011 | 46678 | NM_000059.3(BRCA2): c.7857G > A (p.Trp2619Ter) | BRCA2 |
| 104894503 | 27495 | NM_001018005.1(TPM1): c.523G > A (p.Asp175Asn) | TPM1 |
| 121908641 | 21368 | NM_000050.4(ASS1): c.1168G > A (p.Gly390Arg) | ASS1 |
| 121918593 | 28009 | NM_000540.2(RYR1): c.7300G > A (p.Gly2434Arg) | RYR1 |
| 140108514 | 100191 | NM_003494.3(DYSF): c.2643 + 1G > A | DYSF |
| 145138923 | 98271 | NM_000048.3(ASL): c.35G > A (p.Arg12Gln) | ASL |
| 150726175 | 45795 | NM_022787.3(NMNAT1): c.769G > A (p.Glu257Lys) | NMNAT1 |
| 267607578 | 45138 | NM_170707.3(LMNA): c.1412G > A (p.Arg471His) | LMNA |
| 376607329 | 48992 | NM_002834.4(PTPN11): c.794G > A (p.Arg265Gln) | PTPN11 |
| 587776934 | 48407 | NM_005027.3(PIK3R2): c.1117G > A (p.Gly373Arg) | PIK3R2 |
| 62508588 | 15630 | NM_000277.1(PAH): c.728G > A (p.Arg243Gln) | PAH |
| 62637014 | 20604 | NM_014336.4(AIPL1): c.834G > A (p.Trp278Ter) | AIPL1 |
| 80356860 | 46194 | NM_007294.3(BRCA1): c.5117G > A (p.Gly1706Glu) | BRCA1 |
| 80357268 | 70265 | NM_007294.3(BRCA1): c.5497G > A (p.Val1833Met) | BRCA1 |
| 80357418 | 70077 | NM_007294.3(BRCA1): c.5136G > A (p.Trp1712Ter) | BRCA1 |
| 80358145 | 46229 | NM_007294.3(BRCA1): c.5467 + 1G > A | BRCA1 |
| 121918166 | 15994 | NM_000275.2(OCA2): c.1327G > A (p.Val443Ile) | OCA2 |
| 140342925 | 150591 | NM_001128425.1(MUTYH): c.734G > A (p.Arg245His) | MUTYH |
| 148660051 | 195093 | NM_206933.2(USH2A): c.10073G > A (p.Cys3358Tyr) | USH2A |
| 193922672 | 45341 | NM_004572.3(PKP2): c.1613G > A (p.Trp538Ter) | PKP2 |
| 267607144 | 20039 | NM_021625.4(TRPV4): c.806G > A (p.Arg269His) | TRPV4 |
| 397516083 | 51977 | NM_000256.3(MYBPC3): c.927-9G > A | MYBPC3 |
| 397516357 | 52565 | NM_000363.4(TNNI3): c.557G > A (p.Arg186Gln) | TNNI3 |
| 587782958 | 165560 | NM_000256.3(MYBPC3): c.3190 + 5G > A | MYBPC3 |
| 28934907 | 26853 | NM_004992.3(MECP2): c.316C > T (p.Arg106Trp) | MECP2 |
| 28934908 | 26862 | NM_004992.3(MECP2): c.419C > T (p.Ala140Val) | MECP2 |
| 28940893 | 18091 | NM_000487.5(ARSA): c.1283C > T (p.Pro428Leu) | ARSA |
| 63751422 | 96795 | NM_000535.5(PMS2): c.1927C > T (p.Gln643Ter) | PMS2 |
| 74315366 | 27817 | NM_003000.2(SDHB): c.268C > T (p.Arg90Ter) | SDHB |
| 80338856 | 34127 | NM_001360.2(DHCR7): c.724C > T (p.Arg242Cys) | DHCR7 |
| 80357038 | 69707 | NM_007294.3(BRCA1): c.3895C > T (p.Gln1299Ter) | BRCA1 |
| 80357136 | 69535 | NM_007294.3(BRCA1): c.3403C > T (p.Gln1135Ter) | BRCA1 |
| 80357208 | 69682 | NM_007294.3(BRCA1): c.3817C > T (p.Gln1273Ter) | BRCA1 |
| 80357234 | 69166 | NM_007294.3(BRCA1): c.220C > T (p.Gln74Ter) | BRCA1 |
| 80357262 | 69729 | NM_007294.3(BRCA1): c.3967C > T (p.Gln1323Ter) | BRCA1 |
| 80357305 | 69822 | NM_007294.3(BRCA1): c.4258C > T (p.Gln1420Ter) | BRCA1 |
| 80357350 | 69232 | NM_007294.3(BRCA1): c.241C > T (p.Gln81Ter) | BRCA1 |
| 104894636 | 20147 | NM_000199.3(SGSH): c.220C > T (p.Arg74Cys) | SGSH |
| 111401431 | 44742 | NM_000138.4(FBN1): c.4588C > T (p.Arg1530Cys) | FBN1 |
| 121918624 | 27928 | NM_006920.5(SCN1A): c.664C > T (p.Arg222Ter) | SCN1A |
| 137852981 | 19794 | NM_014795.3(ZEB2): c.2083C > T (p.Arg695Ter) | ZEB2 |
| 137854476 | 31491 | NM_000138.4(FBN1): c.1585C > T (p.Arg529Ter) | FBN1 |
| 137854480 | 31500 | NM_000138.4(FBN1): c.718C > T (p.Arg240Cys) | FBN1 |
| 180177100 | 133574 | NM_024675.3(PALB2): c.1240C > T (p.Arg414Ter) | PALB2 |
| 193922109 | 44392 | NM_000053.3(ATP7B): c.3955C > T (p.Arg1319Ter) | ATP7B |
| 200640585 | 96857 | NM_000535.6(PMS2): c.943C > T (p.Arg315Ter) | PMS2 |
| 201431517 | 48426 | NM_139242.3(MTFMT): c.626C > T (p.Ser209Leu) | MTFMT |
| 397516037 | 51905 | NM_000256.3(MYBPC3): c.3697C > T (p.Gln1233Ter) | MYBPC3 |
| 587780104 | 133350 | NM_002878.3(RAD51D): c.694C > T (p.Arg232Ter) | RAD51D |
| 765123255 | 181726 | NM_001128425.1(MUTYH): c.325C > T (p.Arg109Trp) | MUTYH |
| 63751657 | 95331 | NM_000249.3(MLH1): c.1731G > A (p.Ser577=) | MLH1 |
| 75549581 | 22162 | NM_000492.3(CFTR): c.1675G > A (p.Ala559Thr) | CFTR |
| 80338851 | 16303 | NM_194318.3(B3GLCT): c.660 + 1G > A | B3GLCT |
| 80358544 | 46368 | NM_000059.3(BRCA2): c.2979G > A (p.Trp993Ter) | BRCA2 |
| 111033178 | 52388 | NM_000260.3(MYO7A): c.3719G > A (p.Arg1240Gln) | MYO7A |
| 121908188 | 19535 | NM_020451.2(SELENON): c.943G > A (p.Gly315Ser) | SELENON |
| 139770721 | 180483 | NM_000051.3(ATM): c.6095G > A (p.Arg2032Lys) | ATM |
| 199476315 | 40542 | NM_001018005.1(TPM1): c.574G > A (p.Glu192Lys) | TPM1 |
| 267607004 | 15310 | NM_001134363.2(RBM20): c.1907G > A (p.Arg636His) | RBM20 |
| 267608122 | 94980 | NM_000179.2(MSH6): c.4001G > A (p.Arg1334Gln) | MSH6 |
| 377349459 | 150947 | NM_000051.3(ATM): c.7913G > A (p.Trp2638Ter) | ATM |

TABLE 34-continued

Disease Targets for Base Editing

| RS# | AlleleID | Name | GeneSymbol |
|---|---|---|---|
| 387906303 | 18745 | NM_000527.4(LDLR): c.670G > A (p.Asp224Asn) | LDLR |
| 587779227 | 94719 | NM_000179.2(MSH6): c.2057G > A (p.Gly686Asp) | MSH6 |
| 587780290 | 134019 | NM_000070.2(CAPN3): c.2243G > A (p.Arg748Gln) | CAPN3 |
| 727504317 | 49251 | NM_002755.3(MAP2K1): c1199G > A (p.Asp67Asn) | MAP2K1 |
| 5030869 | 25402 | NM_000402.4(G6PD): c.1093G > A (p.Ala365Thr) | G6PD |
| 9332964 | 18390 | NM_000348.3(SRD5A2): c.680G > A (p.Arg227Gln) | SRD5A2 |
| 36211723 | 45266 | NM_000256.3(MYBPC3): c.2308G > A (p.Asp770Asn) | MYBPC3 |
| 72549410 | 78547 | NM_000335.4(SCN5A): c.1231G > A (p.Val411Met) | SCN5A |
| 80357498 | 45948 | NM_007294.3(BRCA1): c.116G > A (p.Cys39Tyr) | BRCA1 |
| 80358079 | 70118 | NM_007294.3(BRCA1): c.5194-12G > A | BRCA1 |
| 121434529 | 33201 | NM_000262.2(NAGA): c.973G > A (p.Glu325Lys) | NAGA |
| 121908627 | 21067 | NM_005476.5(GNE): c.2086G > A (p.Val696Met) | GNE |
| 387906592 | 38552 | NM_001613.2(ACTA2): c.536G > A (p.Arg179His) | ACTA2 |
| 397515907 | 51711 | NM_000256.3(MYBPC3): c.1505G > A (p.Arg502Gln) | MYBPC3 |
| 397516089 | 51992 | NM_000257.4(MYH7): c.1106G > A (p.Arg369Gln) | MYH7 |
| 397516248 | 52239 | NM_000257.4(MYH7): c.5401G > A (p.Glu1801Lys) | MYH7 |
| 397516349 | 52554 | NM_000363.4(TNNI3): c.434G > A (p.Arg145Gln) | TNNI3 |
| 5030846 | 15627 | NM_000277.3(PAH): c.727C > T (p.Arg243Ter) | PAH |
| 28941784 | 18134 | NM_052845.3(MMAB): c.556C > T (p.Arg186Trp) | MMAB |
| 34126013 | 181693 | NM_001128425.1(MUTYH): c.721C > T (p.Arg241Trp) | MUTYH |
| 62541771 | 21074 | NM_001128227.2(GNE): c.1985C > T (p.Ala662Val) | GNE |
| 62625303 | 68931 | NM_007294.3(BRCA1): c.1471C > T (p.Gln491Ter) | BRCA1 |
| 74315379 | 27453 | NM_001001430.2(TNNT2): c.421C > T (p.Arg141Trp) | TNNT2 |
| 76687508 | 108539 | NM_000277.3(PAH): c.721C > T (p.Arg241Cys) | PAH |
| 80338794 | 20654 | NM_012434.4(SLC17A5): c.115C > T (p.Arg39Cys) | SLC17A5 |
| 80356866 | 69689 | NM_007294.3(BRCA1): c.3841C > T (p.Gln1281Ter) | BRCA1 |
| 80357134 | 69569 | NM_007294.3(BRCA1): c.34C > T (p.Gln12Ter) | BRCA1 |
| 80357229 | 69904 | NM_007294.3(BRCA1): c.4609C > T (p.Gln1537Ter) | BRCA1 |
| 111033260 | 19972 | NM_033056.3(PCDH15): c.733C > T (p.Arg245Ter) | PCDH15 |
| 121909398 | 17403 | NM_201548.4(CERKL): c.769C > T (p.Arg257Ter) | CERKL |
| 121913637 | 29143 | NM_000257.4(MYH7): c.2155C > T (p.Arg719Trp) | MYH7 |
| 200495564 | 50200 | NM_001128425.1(MUTYH): c.733C > T (p.Arg245Cys) | MUTYH |
| 267607203 | 20760 | NM_194456.1(KRIT1): c.1363C > T (p.Gln455Ter) | KRIT1 |
| 587776527 | 132239 | NM_024675.3(PALB2): c.3256C > T (p.Arg1086Ter) | PALB2 |
| 587777219 | 125784 | NM_172107.3(KCNQ2): c.794C > T (p.Ala265Val) | KCNQ2 |
| 587778617 | 96774 | NM_000535.5(PMS2): c.1261C > T (p.Arg421Ter) | PMS2 |
| 587783057 | 166274 | NM_001128425.1(MUTYH): c.1171C > T (p.Gln391Ter) | MUTYH |
| 730880099 | 178699 | NM_000138.4(FBN1): c.1633C > T (p.Arg545Cys) | FBN1 |
| 2309689 | 33868 | NM_000018.3(ACADVL): c.1322G > A (p.Gly441Asp) | ACADVL |
| 28933093 | 29543 | NM_170707.3(LMNA): c.481G > A (p.Glu161Lys) | LMNA |
| 28937873 | 20571 | NM_014249.3(NR2E3): c.932G > A (p.Arg311Gln) | NR2E3 |
| 59332535 | 77828 | NM_170707.3(LMNA): c.746G > A (p.Arg249Gln) | LMNA |
| 62645748 | 48213 | NM_201253.2(CRB1): c.2843G > A (p.Cys948Tyr) | CRB1 |
| 63750828 | 96748 | NM_000251.2(MSH2): c.998G > A (p.Cys333Tyr) | MSH2 |
| 80358456 | 65843 | NM_000059.3(BRCA2): c.1689G > A (p.Trp563Ter) | BRCA2 |
| 80359101 | 67273 | NM_000059.3(BRCA2): c.8489G > A (p.Trp2830Ter) | BRCA2 |
| 80359148 | 131733 | NM_000059.3(BRCA2): c.8969G > A (p.Trp2990Ter) | BRCA2 |
| 80359149 | 67384 | NM_000059.3(BRCA2): c.8970G > A (p.Trp2990Ter) | BRCA2 |
| 80359211 | 46791 | NM_000059.3(BRCA2): c.9380G > A (p.Trp3127Ter) | BRCA2 |
| 111033565 | 26915 | NM_002769.4(PRSS1): c.365G > A (p.Arg122His) | PRSS1 |
| 113994205 | 19482 | NM_004937.2(CTNS): c.414G > A (p.Trp138Ter) | CTNS |
| 116840778 | 23322 | NM_033337.2(CAV3): c.80G > A (p.Arg27Gln) | CAV3; SSUH2 |
| 118192158 | 76835 | NM_000540.2(RYR1): c.14818G > A (p.Ala4940Thr) | RYR1 |
| 121434278 | 18633 | NM_000016.5(ACADM): c.583G > A (p.Gly195Arg) | ACADM |
| 121434346 | 17058 | NM_001003841.2(SLC6A19): c.517G > A(p.Asp173Asn) | SLC6A19 |
| 121908011 | 18814 | NM_000372.4(TYR): c.1147G > A (p.Asp383Asn) | TYR |
| 121908638 | 21365 | NM_000050.4(ASS1): c.539G > A (p.Ser180Asn) | ASS1 |
| 121912938 | 32219 | NM_001848.2(COL6A1): c.850G > A (p.Gly284Arg) | COL6A1 |
| 137853094 | 22694 | NM_000414.3(HSD17B4): c.46G > A (p.Gly16Ser) | HSD17B4 |
| 151344631 | 45847 | NM_000218.2(KCNQ1): c.613G > A (p.Val205Met) | KCNQ1 |
| 192838388 | 98283 | NM_000050.4(ASS1): c.787G > A (p.Val263Met) | ASS1 |
| 267607768 | 95759 | NM_000249.3(MLH1): c.588 + 5G > A | MLH1 |
| 376107921 | 213634 | NM_000070.2(CAPN3): c.1319G > A (p.Arg440Gln) | CAPN3 |
| 397507981 | 67234 | NM_000059.3(BRCA2): c.8364G > A (p.Trp2788Ter) | BRCA2 |
| 398124321 | 101692 | NM_017780.3(CHD7): c.5405-7G > A | CHD7 |
| 730882246 | 181441 | NM_194279.3(ISCA2): c.229G > A (p.Gly77Ser) | ISCA2 |
| 778906552 | 195186 | NM_000016.5(ACADM): c.443G > A (p.Arg148Lys) | ACADM |
| 139428292 | 39421 | NM_005105.4(RBM8A): c.−21G > A | RBM8A |
| 28934891 | 15165 | NM_000071.2(CBS): c.1330G > A (p.Asp444Asn) | CBS |
| 28937316 | 24408 | NM_198056.2(SCN5A): c.4931G > A (p.Arg1644His) | SCN5A |
| 33930165 | 30165 | NM_000518.5(HBB): c.19G > A (p.Glu7Lys) | HBB |
| 35004220 | 30493 | NM_000518.5(HBB): c.93-21G > A | HBB |
| 45546039 | 48043 | NM_198056.2(SCN5A): c.665G > A (p.Arg222Gln) | SCN5A |
| 61751402 | 105177 | NM_000350.2(ABCA4): c.4469G > A (p.Cys1490Tyr) | ABCA4 |
| 72549387 | 22776 | NM_000104.3(CYP1B1): c.171G > A (p.Trp57Ter) | CYP1B1 |
| 75822236 | 19350 | NM_000157.3(GBA): c.1604G > A (p.Arg535His) | GBA |

TABLE 34-continued

Disease Targets for Base Editing

| RS# | AlleleID | Name | GeneSymbol |
|---|---|---|---|
| 79389353 | 20821 | NM_014270.4(SLC7A9): c.544G > A (p.Ala182Thr) | SLC7A9 |
| 80338862 | 34124 | NM_001360.2(DHCR7): c.1228G > A (p.Gly410Ser) | DHCR7 |
| 80338892 | 27366 | NM_199292.2(TH): c.698G > A (p.Arg233His) | TH |
| 80356935 | 68777 | NM_007294.3(BRCA1): c.1059G > A (p.Trp353Ter) | BRCA1 |
| 80357468 | 68802 | NM_007294.3(BRCA1): c.1116G > A (p.Trp372Ter) | BRCA1 |
| 104894365 | 27628 | NM_004985.4(KRAS): c.40G > A (p.Val14Ile) | KRAS |
| 104894639 | 20153 | NM_000199.3(SGSH): c.1339G > A (p.Glu447Lys) | SGSH |
| 111033364 | 17396 | NM_206933.2(USH2A): c.11864G > A (p.Trp3955Ter) | USH2A |
| 119103251 | 17338 | NM_005609.3(PYGM): c.613G > A (p.Gly205Ser) | PYGM |
| 119455954 | 17681 | NM_000391.3(TPP1): c.1094G > A (p.Cys365Tyr) | TPP1 |
| 121913638 | 29144 | NM_000257.4(MYH7): c.2146G > A (p.Gly716Arg) | MYH7 |
| 137854478 | 31496 | NM_000138.4(FBN1): c.3217G > A (p.Glu1073Lys) | FBN1 |
| 143353451 | 179937 | NM_001128425.1(MUTYH): c.545G > A (p.Arg182His) | MUTYH |
| 151045328 | 20182 | NM_005709.3(USH1C): c.216G > A (p.Val72=) | USH1C |
| 151344623 | 24127 | NM_001287174.1(ABCC8): c.3992-9G > A | ABCC8 |
| 193922204 | 44739 | NM_000138.4(FBN1): c.4460-8G > A | FBN1 |
| 193922219 | 51564 | NM_000138.4(FBN1): c.5788 + 5G > A | FBN1 |
| 193922680 | 33370 | NM_005159.4(ACTC1): c.301G > A (p.Glu101Lys) | ACTC1 |
| 267608172 | 96804 | NM_000535.5(PMS2): c.2174 + 1G > A | PMS2 |
| 397516202 | 52163 | NM_000257.3(MYH7): c.4135G > A (p.Ala1379Thr) | MYH7 |
| 397516209 | 52176 | NM_000257.4(MYH7): c.428G > A (p.Arg143Gln) | MYH7 |
| 397517159 | 49176 | NM_005633.3(SOS1): c.2536G > A (p.Glu846Lys) | SOS1 |
| 587776576 | 18532 | NM_024426.5(WT1): c.1447 + 5G > A | WT1 |
| 727503246 | 175600 | NM_000257.4(MYH7): c.4066G > A (p.Glu1356Lys) | MYH7 |
| 730881687 | 181107 | NM_007194.4(CHEK2): c.793-1G > A | CHEK2 |
| 748170941 | 181727 | NM_001128425.1(MUTYH): c.309G > A (p.Trp103Ter) | MUTYH |
| 140583 | 260073 | NM_000138.4(FBN1): c.2581C > T (p.Arg861Ter) | FBN1 |
| 2754158 | 175617 | NM_000257.3(MYH7): c.2572C > T (p.Arg858Cys) | MYH7 |
| 28931570 | 33013 | NM_001127701.1(SERPINA1): c.187C > T(p.Arg63Cys) | SERPINA1 |
| 34424986 | 22089 | NM_004562.2(PRKN): c.823C > T (p.Arg275Trp) | PRKN |
| 61750130 | 22943 | NM_000350.2(ABCA4): c.4139C > T (p.Pro1380Leu) | ABCA4 |
| 61750200 | 22937 | NM_000350.2(ABCA4): c.634C > T (p.Arg212Cys) | ABCA4 |
| 63750451 | 24281 | NM_000535.5(PMS2): c.1882C > T (p.Arg628Ter) | PMS2 |
| 72653706 | 21598 | NM_001171.5(ABCC6): c.3421C > T (p.Arg1141Ter) | ABCC6 |
| 74503222 | 108557 | NM_000277.3(PAH): c.745C > T (p.Leu249Phe) | PAH |
| 76296470 | 15620 | NM_000277.3(PAH): c.331C > T (p.Arg111Ter) | PAH |
| 80338860 | 21826 | NM_001360.2(DHCR7): c.1054C > T (p.Arg352Trp) | DHCR7 |
| 80356682 | 29578 | NM_000228.2(LAMB3): c.1903C > T (p.Arg635Ter) | LAMB3 |
| 80356771 | 19334 | NM_001005741.2(GBA): c.1504C > T (p.Arg502Cys) | GBA |
| 80356904 | 68978 | NM_007294.3(BRCA1): c.1621C > T (p.Gln541Ter) | BRCA1 |
| 80356932 | 69850 | NM_007294.3(BRCA1): c.4372C > T (p.Gln1458Ter) | BRCA1 |
| 80356947 | 70087 | NM_007294.3(BRCA1): c.514C > T (p.Gln172Ter) | BRCA1 |
| 80356992 | 69906 | NM_007294.3(BRCA1): c.4612C > T (p.Gln1538Ter) | BRCA1 |
| 80357133 | 70034 | NM_007294.3(BRCA1): c.505C > T (p.Gln169Ter) | BRCA1 |
| 80357215 | 68781 | NM_007294.3(BRCA1): c.1066C > T (p.Gln356Ter) | BRCA1 |
| 104894419 | 22712 | NM_002312.3(LIG4): c.2440C > T (p.Arg814Ter) | LIG4 |
| 113871094 | 44746 | NM_000138.4(FBN1): c.4786C > T (p.Arg1596Ter) | FBN1 |
| 118203682 | 58105 | NM_000368.4(TSC1): c.2356C > T (p.Arg786Ter) | TSC1 |
| 121908177 | 19611 | NM_031885.3(BBS2): c.823C > T (p.Arg275Ter) | BBS2 |
| 121908715 | 16998 | NM_000022.2(ADA): c.986C > T (p.Ala329Val) | ADA |
| 121909122 | 22411 | NM_001083962.1(TCF4): c.1153C > T (p.Arg385Ter) | TCF4 |
| 121917901 | 16740 | NM_000124.3(ERCC6): c.2203C > T (p.Arg735Ter) | ERCC6 |
| 121964964 | 15158 | NM_000071.2(CBS): c.341C > T (p.Ala114Val) | CBS |
| 137852924 | 18422 | NM_147127.4(EVC2): c.1195C > T (p.Arg399Ter) | EVC2 |
| 137854466 | 31478 | NM_000138.4(FBN1): c.8326C > T (p.Arg2776Ter) | FBN1 |
| 137854467 | 31479 | NM_000138.4(FBN1): c.364C > T (p.Arg122Cys) | FBN1 |
| 137854604 | 24422 | NM_000335.4(SCN5A): c.5126C > T (p.Ser1709Leu) | SCN5A |
| 150518260 | 51200 | NM_000232.4(SGCB): c.341C > T (p.Ser114Phe) | SGCB |
| 200432447 | 133521 | NM_007194.4(CHEK2): c.1555C > T (p.Arg519Ter) | CHEK2 |
| 201587138 | 176561 | NM_144612.6(LOXHD1): c.4480C > T (p.Arg1494Ter) | LOXHD1 |
| 367543286 | 70502 | NM_002609.3(PDGFRB): c.1681C > T (p.Arg561Cys) | PDGFRB |
| 372827156 | 54183 | NM_004572.3(PKP2): c.1237C > T (p.Arg413Ter) | PKP2 |
| 374950566 | 181683 | NM_001128425.1(MUTYH): c.884C > T (p.Pro295Leu) | MUTYH |
| 397514558 | 48266 | NM_000138.4(FBN1): c.2920C > T (p.Arg974Cys) | FBN1 |
| 397515992 | 51839 | NM_000256.3(MYBPC3): c.2905C > T (p.Gln969Ter) | MYBPC3 |
| 397516456 | 52796 | NM_000364.3(TNNT2): c.304C > T (p.Arg102Trp) | TNNT2 |
| 587780082 | 133292 | NM_001128425.1(MUTYH): c.1012C > T (p.Gln338Ter) | MUTYH |
| 587782705 | 152480 | NM_000546.5(TP53): c.455C > T (p.Pro152Leu) | TP53 |
| 727503974 | 177432 | NM_172107.3(KCNQ2): c.821C > T (p.Thr274Met) | KCNQ2 |
| 730881864 | 180279 | NM_002485.4(NBN): c.2140C > T (p.Arg714Ter) | NBN |
| 767215758 | 188057 | NM_002485.4(NBN): c.1030C > T (p.Gln344Ter) | NBN |
| 45517259 | 27442 | NM_000548.3(TSC2): c.2714G > A (p.Arg905Gln) | TSC2 |
| 61195471 | 57234 | NM_170707.3(LMNA): c.607G > A (p.Glu203Lys) | LMNA |
| 61753185 | 18815 | NM_000372.4(TYR): c.230G > A (p.Arg77Gln) | TYR |
| 63749869 | 28021 | NM_000540.2(RYR1): c.14582G > A (p.Arg4861His) | RYR1 |
| 63749939 | 32145 | NM_000249.3(MLH1): c.200G > A (p.Gly67Glu) | MLH1 |

TABLE 34-continued

Disease Targets for Base Editing

| RS# | AlleleID | Name | GeneSymbol |
|---|---|---|---|
| 63750119 | 150580 | NM_000179.2(MSH6): c.3725G > A (p.Arg1242His) | MSH6 |
| 72554308 | 26053 | NM_000531.5(OTC): c.119G > A (p.Arg40His) | OTC |
| 79891110 | 32671 | NM_000719.6(CACNA1C): c.1216G > A (p.Gly406Arg) | CACNA1C |
| 80338707 | 22758 | NM_000303.2(PMM2): c.691G > A (p.Val231Met) | PMM2 |
| 80338802 | 32652 | NM_000070.2(CAPN3): c.2306G > A (p.Arg769Gln) | CAPN3 |
| 80356700 | 32571 | NM_000083.2(CLCN1): c.689G > A (p.Gly230Glu) | CLCN1 |
| 80359803 | 67339 | NM_000059.3(BRCA2): c.8754G > A (p.Glu2918=) | BRCA2 |
| 81002809 | 67078 | NM_000059.3(BRCA2): c.7805 + 1G > A | BRCA2 |
| 104886142 | 35796 | NM_000495.4(COL4A5): c.1871G > A (p.Gly624Asp) | COL4A5 |
| 104894423 | 17048 | NM_000231.2(SGCG): c.787G > A (p.Glu263Lys) | SGCG |
| 104894525 | 22747 | NM_000303.2(PMM2): c.385G > A (p.Val129Met) | PMM2 |
| 113994049 | 20984 | NM_003907.3(EIF2B5): c.338G > A (p.Arg113His) | EIF2B5 |
| 121434372 | 17127 | NM_000159.3(GCDH): c.1198G > A (p.Val400Met) | GCDH |
| 121908099 | 19299 | NM_000784.3(CYP27A1): c.1214G > A (p.Arg405Gln) | CYP27A1 |
| 121908192 | 23730 | NM_005262.2(GFER): c.581G > A (p.Arg194His) | GFER |
| 121908753 | 22237 | NM_000492.3(CFTR): c.1055G > A (p.Arg352Gln) | CFTR |
| 121918013 | 28716 | NM_000478.4(ALPL): c.346G > A (p.Ala116Thr) | ALPL |
| 139729994 | 68418 | NM_000492.3(CFTR): c.3468G > A (p.Leu1156=) | CFTR |
| 142637046 | 98272 | NM_000048.3(ASL): c.446 + 1G > A | ASL |
| 142761835 | 177782 | NM_002225.3(IVD): c.367G > A (p.Gly123Arg) | IVD |
| 146015592 | 46845 | NM_000060.4(BTD): c.470G > A (p.Arg157His) | BTD |
| 150877497 | 226470 | NM_003494.3(DYSF): c.3113G > A (p.Arg1038Gln) | DYSF |
| 199472815 | 67686 | NM_000218.2(KCNQ1): c.1781G > A (p.Arg594Gln) | KCNQ1 |
| 199474738 | 79199 | NM_001042492.2(NF1): c.1885G > A (p.Gly629Arg) | NF1 |
| 199476112 | 24747 | NC_012920.1: m.11778G > A | MT-ND4 |
| 199476317 | 40544 | NM_001018005.1(TPM1): c.688G > A (p.Asp230Asn) | TPM1 |
| 201540674 | 51186 | RTEL1: c.2402G > A (p.Arg801His) | RTEL1 |
| 267606640 | 16147 | NM_000642.2(AGL): c.3980G > A (p.Trp1327Ter) | AGL |
| 386834233 | 76679 | NM_183050.3(BCKDHB): c.832G > A (p.Gly278Ser) | BCKDHB |
| 397515355 | 19301 | NM_000784.3(CYP27A1): c.1263 + 1G > A | CYP27A1 |
| 397515404 | 48194 | NM_020822.2(KCNT1): c.1421G > A (p.Arg474His) | KCNT1 |
| 398123787 | 100221 | NM_003494.3(DYSF): c.4253G > A (p.Gly1418Asp) | DYSF |
| 398124641 | 44139 | NM_024531.4(SLC52A2): c.916G > A (p.Gly306Arg) | SLC52A2 |
| 587776783 | 132342 | NM_000321.2(RB1): c.1215 + 1G > A | RB1 |
| 587776889 | 39757 | NM_015506.2(MMACHC): c.609G > A (p.Trp203Ter) | MMACHC |
| 587777721 | 165903 | NM_014191.3(SCN8A): c.4850G > A (p.Arg1617Gln) | SCN8A |
| 587779818 | 132798 | NM_000051.3(ATM): c.170G > A (p.Trp57Ter) | ATM |
| 587780537 | 136457 | NM_004360.4(CDH1): c.715G > A (p.Gly239Arg) | CDH1 |
| 587783050 | 166264 | NM_004360.5(CDH1): c.1137G > A (p.Thr379=) | CDH1 |
| 751995154 | 200340 | NM_000018.4(ACADVL): c.1376G > A (p.Arg459Gln) | ACADVL |
| 781404312 | 186796 | NM_000051.3(ATM): c.3G > A (p.Met1Ile) | ATM |
| 786202112 | 184694 | NM_001042492.2(NF1): c.5609G > A (p.Arg1870Gln) | NF1 |
| 794727152 | 191718 | NM_021007.2(SCN2A): c.2558G > A (p.Arg853Gln) | SCN2A |
| 796051858 | 18086 | NM_000051.3(ATM): c.496 + 5G > A | ATM |
| 796052505 | 201880 | NM_000816.3(GABRG2): c.316G > A (p.Ala106Thr) | GABRG2 |
| 863223408 | 210238 | NM_000020.2(ACVRL1): c.1451G > A (p.Arg484Gln) | ACVRL1 |
| 863225082 | 188114 | NM_006245.3(PPP2R5D): c.592G > A (p.Glu198Lys) | PPP2R5D |
| 875989911 | 228151 | NM_000527.4(LDLR): c.938G > A (p.Cys313Tyr) | LDLR |
| 5030852 | 15638 | NM_000277.3(PAH): c.842 + 1G > A | PAH |
| 5030859 | 15651 | NM_000277.3(PAH): c.1223G > A (p.Arg408Gln) | PAH |
| 28930068 | 32662 | NM_000069.2(CACNA1S): c.3716G > A (p.Arg1239His) | CACNA1S |
| 56264519 | 55267 | NM_024022.2(TMPRSS3): c.1276G > A (p.Ala426Thr) | TMPRSS3 |
| 61750641 | 105317 | NM_000350.2(ABCA4): c.6089G > A (p.Arg2030Gln) | ABCA4 |
| 61751276 | 104715 | NM_000329.2(RPE65): c.11 + 5G > A | RPE65 |
| 62507336 | 108472 | NM_000277.3(PAH): c.561G > A (p.Trp187Ter) | PAH |
| 62508613 | 108291 | NM_000277.2(PAH): c.1199 + 17G > A | PAH |
| 72645357 | 32351 | NM_000088.3(COL1A1): c.994G > A (p.Gly332Arg) | COL1A1 |
| 80338777 | 32664 | NM_000069.2(CACNA1S): c.1583G > A (p.Arg528His) | CACNA1S |
| 80356908 | 68776 | NM_007294.3(BRCA1): c.1058G > A (p.Trp353Ter) | BRCA1 |
| 80357093 | 69031 | NM_007294.3(BRCA1): c.182G > A (p.Cys61Tyr) | BRCA1 |
| 80357219 | 70211 | NM_007294.3(BRCA1): c.5345G > A (p.Trp1782Ter) | BRCA1 |
| 104886460 | 99352 | NM_001005741.2(GBA): c.115 + 1G > A | GBA |
| 104894129 | 27501 | NM_001289.3(TPM2): c.349G > A (p.Glu117Lys) | TPM2 |
| 104894401 | 32056 | NM_004004.5(GJB2): c.428G > A (p.Arg143Gln) | GJB2 |
| 104895085 | 17592 | NM_000243.2(MEFV): c.1958G > A (p.Arg653His) | MEFV |
| 111033299 | 53902 | NM_004004.5(GJB2): c.283G > A (p.Val95Met) | GJB2 |
| 113994139 | 33347 | NM_139276.2(STAT3): c.1909G > A (p.Val637Met) | STAT3 |
| 120074135 | 18010 | NM_000271.4(NPC1): c.2848G > A (p.Val950Met) | NPC1 |
| 121909334 | 23512 | NM_007126.4(VCP): c.572G > A (p.Arg191Gln) | VCP |
| 121918491 | 28307 | NM_000141.4(FGFR2): c.1032G > A(p.Ala344=) | FGFR2 |
| 137852314 | 25406 | NM_000402.4(G6PD): c.577G > A (p.Gly193Ser) | G6PD |
| 137852327 | 25425 | NM_000402.4(G6PD): c.961G > A (p.Val321Met) | G6PD |
| 137853285 | 166061 | NM_000053.3(ATP7B): c.2128G > A (p.Gly710Ser) | ATP7B |
| 138213197 | 133488 | NM_006361.5(HOXB13): c.251G > A (p.Gly84Glu) | HOXB13 |
| 148311934 | 44907 | NM_000162.5(GCK): c.676G > A (p.Val226Met) | GCK |
| 199473684 | 25807 | NM_000169.2(GLA): c.639 + 919G > A | GLA |

TABLE 34-continued

Disease Targets for Base Editing

| RS# | AlleleID | Name | GeneSymbol |
|---|---|---|---|
| 200482683 | 131950 | NM_014625.3(NPHS2): c.868G > A (p.Val290Met) | NPHS2 |
| 371418985 | 232124 | NM_007194.4(CHEK2): c.1232G > A (p.Trp411Ter) | CHEK2 |
| 387907281 | 45778 | NM_152296.4(ATP1A3): c.2443G > A (p.Glu815Lys) | ATP1A3 |
| 397509284 | 70248 | NM_007294.3(BRCA1): c.5445G > A (p.Trp1815Ter) | BRCA1 |
| 397514495 | 152034 | NM_000546.5(TP53): c.542G > A (p.Arg181His) | TP53 |
| 397514581 | 48359 | NM_172107.3(KCNQ2): c.638G > A (p.Arg213Gln) | KCNQ2 |
| 397516101 | 52008 | NM_000257.4(MYH7): c.1358G > A (p.Arg453His) | MYH7 |
| 397516264 | 52270 | NM_000257.3(MYH7): c.715G > A (p.Asp239Asn) | MYH7 |
| 398122822 | 48057 | NM_001111.5(ADAR): c.3019G > A (p.Gly1007Arg) | ADAR |
| 587777446 | 141325 | NM_022168.4(IFIH1): c.2336G > A (p.Arg779His) | IFIH1 |
| 587782962 | 165566 | NM_000257.4(MYH7): c.3158G > A (p.Arg1053Gln) | MYH7 |
| 606231435 | 170985 | NM_152296.4(ATP1A3): c.2267G > A (p.Arg756His) | ATP1A3 |
| 727504247 | 172354 | NM_001001430.2(TNNT2): c.860G > A (p.Trp287Ter) | TNNT2 |
| 730881833 | 179933 | NM_001128425.1(MUTYH): c.857G > A (p.Gly286Glu) | MUTYH |
| 762307622 | 232266 | NM_001128425.1(MUTYH): c.467G > A (p.Trp156Ter) | MUTYH |
| 777759523 | 17038 | NM_199242.2(UNC13D): c.1389 + 1G > A | UNC13D |
| 794728625 | 197538 | NM_130799.2(MEN1): c.784-9G > A | MEN1 |
| 1060499814 | 389282 | NM_024675.3(PALB2): c.108 + 1G > A | PALB2 |
| 25403 | 51465 | NM_000138.4(FBN1): c.184C > T (p.Arg62Cys) | FBN1 |
| 28931591 | 32539 | NM_000744.6(CHRNA4): c.851C > T (p.Ser284Leu) | CHRNA4 |
| 28942108 | 18015 | NM_000271.4(NPC1): c.2932C > T (p.Arg978Cys) | NPC1 |
| 61750152 | 105192 | NM_000350.2(ABCA4): c.4577C > T (p.Thr1526Met) | ABCA4 |
| 61750654 | 105349 | NM_000350.2(ABCA4): c.6445C > T (p.Arg2149Ter) | ABCA4 |
| 61751404 | 105219 | NM_000350.2(ABCA4): c.4918C > T (p.Arg1640Trp) | ABCA4 |
| 61751408 | 22921 | NM_000350.2(ABCA4): c.6079C > T (p.Leu2027Phe) | ABCA4 |
| 63751466 | 24276 | NM_000535.5(PMS2): c.2404C > T (p.Arg802Ter) | PMS2 |
| 72552255 | 44374 | NM_000053.3(ATP7B): c.2930C > T (p.Thr977Met) | ATP7B |
| 74315369 | 27822 | NM_003000.2(SDHB): c.79C > T (p.Arg27Ter) | SDHB |
| 80338680 | 16726 | NM_000528.3(MAN2B1): c.2248C > T (p.Arg750Trp) | MAN2B1 |
| 80356952 | 68980 | NM_007294.3(BRCA1): c.1630C > T (p.Gln544Ter) | BRCA1 |
| 80357011 | 69802 | NM_007294.3(BRCA1): c.4186C > T (p.Gln1396Ter) | BRCA1 |
| 80357296 | 69580 | NM_007294.3(BRCA1): c.3544C > T (p.Gln1182Ter) | BRCA1 |
| 80357367 | 70140 | NM_007294.3(BRCA1): c.5239C > T (p.Gln1747Ter) | BRCA1 |
| 80357377 | 69340 | NM_007294.3(BRCA1): c.2761C > T (p.Gln921Ter) | BRCA1 |
| 80357471 | 69016 | NM_007294.3(BRCA1): c.178C > T (p.Gln60Ter) | BRCA1 |
| 80357497 | 69389 | NM_007294.3(BRCA1): c.2923C > T (p.Gln975Ter) | BRCA1 |
| 104893950 | 18137 | NM_005670.3(EPM2A): c.721C > T (p.Arg241Ter) | EPM2A |
| 104894787 | 26252 | NM_004006.2(DMD): c.10108C > T (p.Arg3370Ter) | DMD |
| 111231312 | 51536 | NM_000138.4(FBN1): c.4615C > T (p.Arg1539Ter) | FBN1 |
| 112645512 | 178700 | NM_000138.4(FBN1): c.1285C > T (p.Arg429Ter) | FBN1 |
| 113001196 | 51577 | NM_000138.4(FBN1): c.6658C > T (p.Arg2220Ter) | FBN1 |
| 113249823 | 51552 | NM_000138.4(FBN1): c.5368C > T (p.Arg1790Ter) | FBN1 |
| 113812345 | 51455 | NM_000138.4(FBN1): c.1546C > T (p.Arg516Ter) | FBN1 |
| 116100695 | 16552 | NM_000298.5(PKLR): c.1456C > T (p.Arg486Trp) | PKLR |
| 118203631 | 58047 | NM_000368.4(TSC1): c.2074C > T (p.Arg692Ter) | TSC1 |
| 118203963 | 16148 | NM_025137.3(SPG11): c.6100C > T (p.Arg2034Ter) | SPG11 |
| 118204437 | 15739 | NM_000512.4(GALNS): c.1156C > T (p.Arg386Cys) | GALNS |
| 121434526 | 33315 | NM_001613.3(ACTA2): c.445C > T (p.Arg149Cys) | ACTA2 |
| 121908547 | 20943 | NM_000334.4(SCN4A): c.3938C > T (p.Thr1313Met) | SCN4A |
| 121912504 | 29459 | NM_000238.3(KCNH2): c.1682C > T (p.Ala561Val) | KCNH2 |
| 121913120 | 31271 | NM_000143.3(FH): c.301C > T (p.Arg101Ter) | FH |
| 121913122 | 31274 | NM_000143.3(FH): c.1027C > T (p.Arg343Ter) | FH |
| 121917783 | 27083 | NM_000136.2(FANCC): c.553C > T (p.Arg185Ter) | FANCC |
| 121918775 | 79496 | NM_006920.4(SCN1A): c.2803C > T (p.Arg935Cys) | SCN1A |
| 121964972 | 15170 | NM_000071.2(CBS): c.1058C > T (p.Thr353Met) | CBS |
| 128627256 | 26327 | NM_004006.2(DMD): c.8713C > T (p.Arg2905Ter) | DMD |
| 137854613 | 24413 | NM_198056.2(SCN5A): c.4867C > T (p.Arg1623Ter) | SCN5A |
| 137886232 | 39244 | NM_002878.3(RAD51D): c.757C > T (p.Arg253Ter) | RAD51D |
| 138996609 | 181608 | NM_003000.2(SDHB): c.688C > T (p.Arg230Cys) | SDHB |
| 144500145 | 202960 | NM_002693.2(POLG): c.2554C > T (p.Arg852Cys) | POLG |
| 180177111 | 132156 | NM_024675.3(PALB2): c.2323C > T (p.Gln775Ter) | PALB2 |
| 185492864 | 99918 | NM_001918.3(DBT): c.901C > T (p.Arg301Cys) | DBT |
| 193922185 | 44706 | NM_000138.4(FBN1): c.1948C > T (p.Arg650Cys) | FBN1 |
| 199472944 | 38732 | NM_000238.3(KCNH2): c.1841C > T (p.Ala614Val) | KCNH2 |
| 199472990 | 78275 | NM_000238.3(KCNH2): c.2254C > T (p.Arg752Trp) | KCNH2 |
| 199473161 | 78626 | NM_198056.2(SCN5A): c.2440C > T (p.Arg814Trp) | SCN5A |
| 199473524 | 78188 | NM_000238.3(KCNH2): c.1838C > T (p.Thr613Met) | KCNH2 |
| 273898674 | 69115 | NM_007294.3(BRCA1): c.2059C > T (p.Gln687Ter) | BRCA1 |
| 368796923 | 151096 | NM_032043.2(BRIP1): c.1240C > T (p.Gln414Ter) | BRIP1 |
| 376128990 | 215031 | NM_052845.3(MMAB): c.571C > T (p.Arg191Trp) | MMAB |
| 397509283 | 70244 | NM_007294.3(BRCA1): c.5431C > T (p.Gln1811Ter) | BRCA1 |
| 397515812 | 51535 | NM_000138.4(FBN1): c.4567C > T (p.Arg1523Ter) | FBN1 |
| 397516005 | 51860 | NM_000256.3(MYBPC3): c.3181C > T (p.Gln1061Ter) | MYBPC3 |
| 397516042 | 51914 | NM_000256.3(MYBPC3): c.3811C > T (p.Arg1271Ter) | MYBPC3 |
| 397516127 | 52044 | NM_000257.3(MYH7): c.1987C > T (p.Arg663Cys) | MYH7 |
| 397516201 | 52162 | NM_000257.4(MYH7): c.4130C > T (p.Thr1377Met) | MYH7 |

TABLE 34-continued

Disease Targets for Base Editing

| RS# | AlleleID | Name | GeneSymbol |
|---|---|---|---|
| 397516435 | 52758 | NM_000546.5(TP53): c.586C > T (p.Arg196Ter) | TP53 |
| 397517689 | 56466 | NM_001267550.2(TTN): c.71602C > T (p.Arg23868Ter) | TTN |
| 398123585 | 99539 | NM_001165963.1(SCN1A): c.1837C > T (p.Arg613Ter) | SCN1A |
| 549794342 | 360490 | NM_001271208.1(NEB): c.24094C > T (p.Arg8032Ter) | NEB |
| 574660186 | 178478 | NM_001267550.2(TTN): c.67495C > T (p.Arg22499Ter) | TTN |
| 575822089 | 227149 | NM_001163435.2(TBCK): c.376C > T (p.Arg126Ter) | TBCK |
| 587778618 | 138806 | NM_000535.7(PMS2): c.1687C > T (p.Arg563Ter) | PMS2 |
| 587779343 | 96837 | NM_000535.5(PMS2): c.697C > T (p.Gln233Ter) | PMS2 |
| 587780088 | 133302 | NM_001128425.1(MUTYH): c.55C > T (p.Arg19Ter) | MUTYH |
| 587781269 | 150486 | NM_007194.4(CHEK2): c.283C > T (p.Arg95Ter) | CHEK2 |
| 587781756 | 151166 | NM_002878.3(RAD51D): c.451C > T (p.Gln151Ter) | RAD51D |
| 672601370 | 171771 | NM_001244008.1(KIF1A): c.946C > T (p.Arg316Trp) | KIF1A |
| 727505006 | 176130 | NM_000138.4(FBN1): c.3373C > T (p.Arg1125Ter) | FBN1 |
| 794728165 | 197808 | NM_000138.4(FBN1): c.1090C > T (p.Arg364Ter) | FBN1 |
| 794728228 | 197690 | NM_000138.4(FBN1): c.4621C > T (p.Arg1541Ter) | FBN1 |
| 794728283 | 197585 | NM_000138.4(FBN1): c.8038C > T (p.Arg2680Cys) | FBN1 |
| 879255678 | 247653 | NM_144997.5(FLCN): c.1429C > T (p.Arg477Ter) | FLCN |
| 886041116 | 263863 | NM_015339.4(ADNP): c.2188C > T (p.Arg730Ter) | ADNP |
| 1553547838 | 512805 | NM_001172509.1(SATB2): c.1375C > T (p.Arg459Ter) | SATB2 |
| 45507199 | 59122 | NM_000548.3(TSC2): c.5228G > A (p.Arg1743Gln) | TSC2 |
| 60458016 | 29564 | NM_170707.3(LMNA): c.1072G > A (p.Glu358Lys) | LMNA |
| 61672878 | 29534 | NM_170707.3(LMNA): c.1130G > A (p.Arg377His) | LMNA |
| 61750173 | 24396 | NM_000180.3(GUCY2D): c.2513G > A (p.Arg838His) | GUCY2D |
| 61753180 | 18833 | NM_000372.4(TYR): c.140G > A (p.Gly47Asp) | TYR |
| 61754375 | 18835 | NM_000372.4(TYR): c.896G > A (p.Arg299His) | TYR |
| 62636275 | 20778 | NM_201253.2(CRB1): c.3307G > A (p.Gly1103Arg) | CRB1 |
| 63750453 | 95615 | NM_000249.3 (MLH1): c.304G > A (p.Glu102Lys) | MLH1 |
| 63750604 | 95363 | NM_000249.3(MLH1): c.1790G > A (p.Trp597Ter) | MLH1 |
| 63751632 | 95404 | NM_000249.3(MLH1): c.1896G > A (p.Glu632=) | MLH1 |
| 74315205 | 19565 | NM_006005.3(WFS1): c.2590G > A (p.Glu864Lys) | WFS1 |
| 74503330 | 22256 | NM_000492.3(CFTR): c.3752G > A (p.Ser1251Asn) | CFTR |
| 80282562 | 57854 | NM_000492.3(CFTR): c.532G > A (p.Gly178Arg) | CFTR |
| 80356702 | 32581 | NM_000083.2(CLCN1): c.950G > A (p.Arg317Gln) | CLCN1 |
| 80358543 | 131539 | NM_000059.3(BRCA2): c.2978G > A (p.Trp993Ter) | BRCA2 |
| 80358810 | 46556 | NM_000059.3(BRCA2): c.582G > A (p.Trp194Ter) | BRCA2 |
| 80358997 | 67062 | NM_000059.3(BRCA2): c.7721G > A (p.Trp2574Ter) | BRCA2 |
| 80359205 | 67482 | NM_000059.3(BRCA2): c.9317G > A (p.Trp3106Ter) | BRCA2 |
| 81002167 | 67120 | NM_000059.3(BRCA2): c.7976 + 1G > A | BRCA2 |
| 104894317 | 18840 | NM_000372.4(TYR): c.1336G > A (p.Gly446Ser) | TYR |
| 104894590 | 16599 | NM_000263.3(NAGLU): c.2021G > A (p.Arg674His) | NAGLU |
| 111033270 | 19955 | NM_022124.5(CDH23): c.5237G > A (p.Arg1746Gln) | CDH23 |
| 111436401 | 226974 | NM_000540.2(RYR1): c.10347 + 1G > A | RYR1 |
| 112406105 | 200333 | NM_000018.4(ACADVL): c.1097G > A (p.Arg366His) | ACADVL |
| 113560320 | 15440 | NM_017841.2(SDHAF2): c.232G > A (p.Gly78Arg) | SDHAF2 |
| 113690956 | 16661 | NM_000018.2(ACADVL): c.1182 + 1G > A | ACADVL |
| 113994171 | 33871 | NM_000018.3(ACADVL): c.1679-6G > A | ACADVL |
| 113994207 | 19490 | NM_004937.2(CTNS): c.589G > A (p.Gly197Arg) | CTNS |
| 114925667 | 260377 | NM_024818.4(UBA5): c.1111G > A (p.Ala371Thr) | UBA5 |
| 118192122 | 76888 | NM_000540.2(RYR1): c.7361G > A (p.Arg2454His) | RYR1 |
| 118192176 | 28015 | NM_000540.2(RYR1): c.6502G > A (p.Val2168Met) | RYR1 |
| 118203982 | 16396 | NM_001080.3(ALDH5A1): c.612G > A (p.Trp204Ter) | ALDH5A1 |
| 119462987 | 18289 | NM_007171.3(POMT1): c.2005G > A (p.Ala669Thr) | POMT1 |
| 120074190 | 18179 | NM_000218.2(KCNQ1): c.1766G > A (p.Gly589Asp) | KCNQ1 |
| 121434544 | 32653 | NM_000070.2(CAPN3): c.1715G > A (p.Arg572Gln) | CAPN3 |
| 121434548 | 32661 | NM_000070.2(CAPN3): c.1469G > A (p.Arg490Gln) | CAPN3; POMT1 |
| 121908153 | 19416 | NM_001243133.1(NLRP3): c.907G > A(p.Asp303Asn) | NLRP3 |
| 121908185 | 19531 | NM_020451.2(SELENON): c.1397G > A (p.Arg466Gln) | SELENON |
| 121908419 | 20395 | NM_014384.2(ACAD8): c.1129G > A (p.Gly377Ser) | ACAD8 |
| 121908759 | 44497 | NM_000492.3(CFTR): c.1865G > A (p.Gly622Asp) | CFTR |
| 121908889 | 21460 | NM_003060.3(SLC22A5): c.506G > A (p.Arg169Gln) | SLC22A5 |
| 121909013 | 22181 | NM_000492.3(CFTR): c.1651G > A (p.Gly551Ser) | CFTR |
| 121909019 | 22197 | NM_000492.3(CFTR): c.3197G > A (p.Arg1066His) | CFTR |
| 121909092 | 22321 | NM_001005360.2(DNM2): c.1102G > A (p.Glu368Lys) | DNM2 |
| 121918009 | 28711 | NM_000478.5(ALPL): c.1001G > A (p.Gly334Asp) | ALPL |
| 121918592 | 28008 | NM_000540.2(RYR1): c.1021G > A (p.Gly341Arg) | RYR1 |
| 137852871 | 17416 | NM_000709.3(BCKDHA): c.868G > A (p.Gly290Arg) | BCKDHA |
| 141158996 | 22214 | NM_000492.3(CFTR): c.2490 + 1G > A | CFTR |
| 141554661 | 208401 | NM_004287.4(GOSR2): c.336 + 1G > A | GOSR2 |
| 148032587 | 194820 | NM_000303.2(PMM2): c.442G > A (p.Asp148Asn) | PMM2 |
| 193922503 | 44492 | NM_000492.3(CFTR): c.1585-8G > A | CFTR |
| 199472687 | 77968 | NM_000218.2(KCNQ1): c.421G > A (p.Val141Met) | KCNQ1 |
| 201016593 | 245339 | NM_000527.4(LDLR): c.11G > A (p.Trp4Ter) | LDLR |
| 267606997 | 21861 | NM_058216.2(RAD51C): c.773G > A (p.Arg258His) | RAD51C |
| 267607914 | 96367 | NM_000251.2(MSH2): c.212-1G > A | MSH2 |
| 369560930 | 98197 | NM_000018.4(ACADVL): c.520G > A (p.Val174Met) | ACADVL |
| 370523609 | 227889 | NM_000016.5(ACADM): c.600-18G > A | ACADM |

TABLE 34-continued

Disease Targets for Base Editing

| RS# | AlleleID | Name | GeneSymbol |
|---|---|---|---|
| 370950728 | 186993 | NM_000152.3(GAA): c.655G > A (p.Gly219Arg) | GAA |
| 374143224 | 187013 | NM_000152.3(GAA): c.1979G > A (p.Arg660His) | GAA |
| 397508045 | 67476 | NM_000059.3(BRCA2): c.92G > A (p.Trp31Ter) | BRCA2 |
| 397508200 | 67910 | NM_000492.3(CFTR): c.1393-1G > A | CFTR |
| 397509418 | 75098 | NM_021942.5(TRAPPC11): c.1287 + 5G > A | TRAPPC11 |
| 397515330 | 76388 | NM_001098512.2(PRKG1): c.530G > A (p.Arg177Gln) | PRKG1 |
| 398122711 | 97208 | NM_000059.3(BRCA2): c.8633-1G > A | BRCA2 |
| 398123139 | 98311 | NM_000060.4(BTD): c.626G > A (p.Arg209His) | BTD |
| 398123763 | 100162 | NM_003494.3(DYSF): c.1053 + 1G > A | DYSF |
| 587777057 | 77012 | NM_020988.2(GNAO1): c.607G > A (p.Gly203Arg) | GNAO1 |
| 587777570 | 150453 | NM_004522.2(KIF5C): c.709G > A (p.Glu237Lys) | KIF5C |
| 587778777 | 76741 | NM_000784.3(CYP27A1): c.1184 + 1G > A | CYP27A1 |
| 587779110 | 96248 | NM_000251.2(MSH2): c.1760-1G > A | MSH2 |
| 587780639 | 139490 | NM_000051.3(ATM): c.7788G > A (p.Glu2596=) | ATM |
| 587781894 | 151348 | NM_000051.3(ATM): c.9023G > A (p.Arg3008His) | ATM |
| 587782719 | 152505 | NM_000051.3(ATM): c.8122G > A (p.Asp2708Asn) | ATM |
| 727503030 | 176785 | NM_001278939.1(ELN): c.1150 + 1G > A | ELN |
| 730881581 | 180665 | NM_000059.3(BRCA2): c.8174G > A (p.Trp2725Ter) | BRCA2 |
| 730882035 | 180121 | NM_000551.3(VHL): c.482G > A (p.Arg161Gln) | VHL |
| 750663117 | 234071 | NM_000051.3(ATM): c.3078-1G > A | ATM |
| 756039188 | 243266 | NM_000527.4(LDLR): c.12G > A (p.Trp4Ter) | LDLR |
| 796053216 | 202741 | NM_014191.3(SCN8A): c.4423G > A (p.Gly1475Arg) | SCN8A |
| 876661242 | 231905 | NM_000059.3(BRCA2): c.9381G > A (p.Trp3127Ter) | BRCA2 |
| 879254600 | 245669 | NM_000527.4(LDLR): c.626G > A (p.Cys209Tyr) | LDLR |
| 1057519632 | 362622 | NM_003718.4(CDK13): c.2149G > A (p.Gly717Arg) | CDK13 |
| 10250779 | 15457 | NM_000290.3(PGAM2): c.233G > A (p.Trp78Ter) | PGAM2 |
| 28928905 | 29469 | NM_000238.3(KCNH2): c.1468G > A (p.Ala490Thr) | KCNH2 |
| 28931593 | 32066 | NM_004004.5(GJB2): c.224G > A (p.Arg75Gln) | GJB2 |
| 28937318 | 24424 | NM_198056.2(SCN5A): c.1100G > A (p.Arg367His) | SCN5A |
| 61749397 | 15329 | NM_000552.4(VWF): c.3946G > A (p.Val1316Met) | VWF |
| 61751403 | 105220 | NM_000350.2(ABCA4): c.4919G > A (p.Arg1640Gln) | ABCA4 |
| 62514907 | 15633 | NM_000277.3(PAH): c.442-1G > A | PAH |
| 62514956 | 98659 | NM_000277.3(PAH): c.912 + 1G > A | PAH |
| 62516146 | 108608 | NM_000277.1(PAH): c.842 + 5G > A | PAH |
| 62642939 | 98657 | NM_000277.2(PAH): c.890G > A (p.Arg297His) | PAH |
| 62644503 | 108560 | NM_000277.3(PAH): c.755G > A (p.Arg252Gln) | PAH |
| 63749856 | 21618 | NM_001171.5(ABCC6): c.3904G > A (p.Gly1302Arg) | ABCC6 |
| 63750783 | 30442 | NM_000518.5(HBB): c.47G > A (p.Trp16Ter) | HBB |
| 66555264 | 414003 | NM_000088.3(COL1A1): c.1821 + 1G > A | COL1A1 |
| 72645321 | 414022 | NM_000088.3(COL1A1): c.769G > A (p.Gly257Arg) | COL1A1 |
| 74315368 | 27820 | NM_003000.2(SDHB): c.725G > A (p.Arg242His) | SDHB |
| 74315471 | 18113 | NM_000487.5(ARSA): c.739G > A (p.Gly247Arg) | ARSA |
| 78973108 | 19367 | NM_001005741.2(GBA): c.887G > A (p.Arg296Gln) | GBA |
| 80338735 | 33917 | NM_000156.5(GAMT): c.327G > A (p.Lys109=) | GAMT |
| 80338857 | 34128 | NM_001360.2(DHCR7): c.725G > A (p.Arg242His) | DHCR7 |
| 80338864 | 21831 | NM_001360.2(DHCR7): c.1342G > A (p.Glu448Lys) | DHCR7 |
| 80338944 | 32040 | NM_004004.5(GJB2): c.231G > A (p.Trp77Ter) | GJB2 |
| 80356914 | 70276 | NM_007294.3(BRCA1): c.5511G > A (p.Trp1837Ter) | BRCA1 |
| 80357212 | 70255 | NM_007294.3(BRCA1): c.5467G > A (p.Ala1823Thr) | BRCA1 |
| 80357307 | 70275 | NM_007294.3(BRCA1): c.5510G > A (p.Trp1837Ter) | BRCA1 |
| 80358252 | 18013 | NM_000271.4(NPC1): c.530G > A (p.Cys177Tyr) | NPC1 |
| 104894103 | 19470 | NM_175073.2(APTX): c.837G > A (p.Trp279Ter) | APTX |
| 104894415 | 20583 | NM_006783.4(GJB6): c.31G > A (p.Gly11Arg) | GJB6 |
| 104894519 | 21096 | NM_004862.3(LITAF): c.334G > A (p.Gly112Ser) | LITAF |
| 104894727 | 27461 | NM_000363.4(TNNI3): c.586G > A (p.Asp196Asn) | TNNI3 |
| 104894828 | 25754 | NM_000169.2(GLA): c.902G > A (p.Arg301Gln) | GLA |
| 111683277 | 175150 | NM_000256.3(MYBPC3): c.3190 + 1G > A | MYBPC3 |
| 111984349 | 258823 | NM_000138.4(FBN1): c.7828G > A (p.Glu2610Lys) | FBN1 |
| 113403872 | 16550 | NM_000298.5(PKLR): c.1529G > A (p.Arg510Gln) | PKLR |
| 121434249 | 18383 | NM_000348.3(SRD5A2): c.682G > A (p.Ala228Thr) | SRD5A2 |
| 121908216 | 23534 | NM_001127221.1(CACNA1A): c.4982G > A (p.Arg1661His) | CACNA1A |
| 121908551 | 20948 | NM_000334.4(SCN4A): c.3877G > A (p.Val1293Ile) | SCN4A |
| 121908552 | 20949 | NM_000334.4(SCN4A): c.1333G > A (p.Val445Met) | SCN4A |
| 121908557 | 20958 | NM_000334.4(SCN4A): c.2024G > A (p.Arg675Gln) | SCN4A |
| 121908716 | 16996 | NM_000022.2(ADA): c.632G > A (p.Arg211His) | ADA |
| 121908723 | 17007 | NM_000022.3(ADA): c.646G > A (p.Gly216Arg) | ADA |
| 121909768 | 21834 | NM_001360.2(DHCR7): c.1055G > A (p.Arg352Gln) | DHCR7 |
| 121913039 | 31702 | NM_001953.4(TYMP): c.622G > A (p.Val208Met) | TYMP |
| 137853050 | 22116 | NM_006009.3(TUBA1A): c.1265G > A (p.Arg422His) | TUBA1A |
| 137853283 | 166064 | NM_000053.3(ATP7B): c.2336G > A (p.Trp779Ter) | ATP7B |
| 137854612 | 24334 | NM_198056.2(SCN5A): c.4222G > A (p.Gly1408Arg) | SCN5A |
| 139751448 | 187031 | NM_000271.4(NPC1): c.1211G > A (p.Arg404Gln) | NPC1 |
| 150038620 | 187049 | NM_004646.3(NPHS1): c.2335-1G > A | NPHS1 |
| 180177122 | 132185 | NM_024675.3(PALB2): c.2718G > A (p.Trp906Ter) | PALB2 |
| 181087667 | 40103 | NM_007055.3(POLR3A): c.2617-1G > A | POLR3A |
| 193922110 | 44393 | NM_000053.3(ATP7B): c.4058G > A (p.Trp1353Ter) | ATP7B |

TABLE 34-continued

Disease Targets for Base Editing

| RS# | AlleleID | Name | GeneSymbol |
|---|---|---|---|
| 199473565 | 78528 | NM_198056.2(SCN5A): c.1066G > A (p.Asp356Asn) | SCN5A |
| 199474703 | 40437 | NM_000258.2(MYL3): c.281G > A (p.Arg94His) | MYL3 |
| 199971687 | 216058 | NM_052845.3(MMAB): c.291-1G > A | MMAB |
| 201188361 | 40345 | NM_014714.3(IFT140): c.634G > A (p.Gly212Arg) | IFT140 |
| 202160208 | 75126 | NM_013334.3(GMPPB): c.860G > A (p.Arg287Gln) | GMPPB |
| 281875334 | 38553 | NM_001101.3(ACTB): c.587G > A(p.Arg196His) | ACTB |
| 386134249 | 45185 | NM_000244.3(MEN1): c.1277G > A (p.Cys426Tyr) | MEN1 |
| 387906623 | 38652 | NM_000138.4(FBN1): c.5284G > A (p.Gly1762Ser) | FBN1 |
| 387906905 | 39430 | NM_021625.4(TRPV4): c.947G > A (p.Arg316His) | TRPV4 |
| 397507479 | 48850 | NM_004333.5(BRAF): c.1595G > A (p.Cys532Tyr) | BRAF |
| 397514494 | 48018 | NM_021625.4(TRPV4): c.557G > A (p.Arg186Gln) | TRPV4 |
| 397515854 | 51599 | NM_000138.4(FBN1): c.7606G > A (p.Gly2536Arg) | FBN1 |
| 397515982 | 51820 | NM_000256.3(MYBPC3): c.2670G > A (p.Trp890Ter) | MYBPC3 |
| 397516031 | 51898 | NM_000256.3(MYBPC3): c.3627 + 1G > A | MYBPC3 |
| 397516471 | 52818 | NM_001001430.2(TNNT2): c.518G > A (p.Arg173Gln) | TNNT2 |
| 398122853 | 38917 | NM_004006.2(DMD): c.9G > A (p.Trp3Ter) | DMD |
| 483352809 | 65656 | NM_006087.3(TUBB4A): c.745G > A (p.Asp249Asn) | TUBB4A |
| 515726205 | 40114 | NM_001031726.3(C19orf12): c.205G > A (p.Gly69Arg) | C19orf12 |
| 564069299 | 200114 | NM_000255.3(MMUT): c.1106G > A (p.Arg369His) | MMUT |
| 574673404 | 182906 | NM_002485.4(NBN): c.37 + 1G > A | NBN |
| 587780345 | 134590 | NM_000162.5(GCK): c.544G > A (p.Val182Met) | GCK |
| 606231324 | 136674 | NM_000257.3(MYH7): c.1573G > A (p.Glu525Lys) | MYH7 |
| 727504382 | 49283 | NM_030662.3(MAP2K2): c.619G > A (p.Glu207Lys) | MAP2K2 |
| 730880850 | 29166 | NM_000257.3(MYH7): c.732 + 1G > A | MYH7 |
| 730882175 | 181517 | NM_002238.3(KCNH1): c.1405G > A (p.Gly469Arg) | KCNH1 |
| 751604696 | 425943 | NM_001360.2(DHCR7): c.1337G > A (p.Arg446Gln) | DHCR7 |
| 753288303 | 216044 | NM_000255.3(MMUT): c.1280G > A (p.Gly427Asp) | MMUT |
| 767399782 | 213656 | NM_006087.3(TUBB4A): c.763G > A (p.Val255Ile) | TUBB4A |
| 794728208 | 197723 | NM_000138.4(FBN1): c.3712G > A (p.Asp1238Asn) | FBN1 |
| 796756333 | 410338 | NM_024422.4(DSC2): c.943-1G > A | DSC2 |
| 797044872 | 205316 | NM_004977.2(KCNC3): c.1268G > A (p.Arg423His) | KCNC3 |
| 797045586 | 207083 | NM_032682.5(FOXP1): c.1541G > A (p.Arg514His) | FOXP1 |
| 863223403 | 209408 | NM_002140.4(HNRNPK): c.257G > A (p.Arg86His) | HNRNPK |
| 876658367 | 232176 | NM_003000.2(SDHB): c.587G > A (p.Cys196Tyr) | SDIIB |
| 1057517585 | 358911 | NM_024675.3(PALB2): c.3G > A (p.Met1Ile) | PALB2 |
| 1555582065 | 431537 | NM_014233.3(UBTF): c.628G > A (p.Glu210Lys) | UBTF |
| 140630 | 197685 | NM_000138.4(FBN1): c.4930C > T (p.Arg1644Ter) | FBN1 |
| 28940869 | 19031 | NM_017739.3(POMGNT1): c.1324C > T (p.Arg442Cys) | POMGNT1 |
| 34451549 | 30497 | NM_000518.5(HBB): c.316-197C > T | HBB |
| 41556519 | 31832 | NM_000400.3(ERCC2): c.2047C > T (p.Arg683Trp) | ERCC2 |
| 45611033 | 175462 | NM_000257.4(MYH7): c.3133C > T (p.Arg1045Cys) | MYH7 |
| 55832599 | 151478 | NM_000546.5(TP53): c.799C > T (p.Arg267Trp) | IP53 |
| 59616921 | 18036 | NM_000226.3(KRT9): c.487C > T (p.Arg163Trp) | KRT9 |
| 60399023 | 29651 | NM_000526.4(KRT14): c.373C > T (p.Arg125Cys) | KRT14 |
| 61749409 | 104973 | NM_000350.2(ABCA4): c.1804C > T (p.Arg602Trp) | ABCA4 |
| 61749423 | 105003 | NM_000350.2(ABCA4): c.2041C > T (p.Arg681Ter) | ABCA4 |
| 61750645 | 105327 | NM_000350.2(ABCA4): c.6229C > T (p.Arg2077Trp) | ABCA4 |
| 61751383 | 22946 | NM_000350.2(ABCA4): c.6088C > T (p.Arg2030Ter) | ABCA4 |
| 61752871 | 28154 | NM_000329.2(RPE65): c.271C > T (p.Arg91Trp) | RPE65 |
| 61757582 | 21827 | NM_001360.2(DHCR7): c.1210C > T (p.Arg404Cys) | DHCR7 |
| 61816761 | 31358 | NM_002016.1(FLG): c.1501C > T (p.Arg501Ter) | FLG |
| 62507344 | 15662 | NM_000277.2(PAH): c.1066-3C > T | PAH |
| 72559722 | 186816 | NM_001287174.1(ABCC8): c.2509C > T (p.Arg837Ter) | ABCC8 |
| 72646846 | 56340 | NM_001256850.1(TTN): c.56953C > T (p.Arg18985Ter) | TTN |
| 72648250 | 225057 | NM_001256850.1(TTN): c.88243C > T (p.Arg29415Ter) | TTN |
| 72650700 | 39295 | NM_001171.5(ABCC6): c.1552C > T(p.Arg518Ter) | ABCC6 |
| 72651642 | 271557 | NM_000088.3(COL1A1): c.2089C > T (p.Arg697Ter) | COL1A1 |
| 72653170 | 32386 | NM_000088.3(COL1A1): c.3040C > T (p.Arg1014Cys) | COL1A1 |
| 74315348 | 20408 | NM_014625.3(NPHS2): c.871C > T (p.Arg291Trp) | NPHS2 |
| 74315391 | 22425 | NM_172107.3(KCNQ2): c.619C > T (p.Arg207Trp) | KCNQ2 |
| 74315442 | 23435 | NM_000100.3(CSTB): c.202C > T (p.Arg68Ter) | CSTB |
| 74315472 | 18114 | NM_000487.5(ARSA): c.827C > T (p.Thr276Met) | ARSA |
| 75166491 | 108429 | NM_000277.3(PAH): c.472C > T (p.Arg158Trp) | PAH |
| 75949023 | 39947 | NM_144612.6(LOXHD1): c.4714C > T (p.Arg1572Ter) | LOXHD1 |
| 78635798 | 16299 | NM_032193.3(RNASEH2C): c.205C > T (p.Arg69Trp) | RNASEH2C |
| 80338652 | 18848 | NM_000081.3(LYST): c.3310C > T (p.Arg1104Ter) | LYST |
| 80338826 | 29117 | NM_002473.5(MYH9): c.2104C > T (p.Arg702Cys) | MYH9 |
| 80338934 | 17522 | NM_024577.3(SH3TC2): c.3325C > T (p.Arg1109Ter) | SH3TC2 |
| 80338957 | 20935 | NM_000334.4(SCN4A): c.2111C > T (p.Thr704Met) | SCN4A |
| 80356680 | 29580 | NM_000228.2(LAMB3): c.124C > T (p.Arg42Ter) | LAMB3 |
| 80356879 | 76552 | NM_001876.3(CPT1A): c.1436C > T (p.Pro479Leu) | CPT1A |
| 80356973 | 69370 | NM_007294.3(BRCA1): c.2869C > T (p.Gln957Ter) | BRCA1 |
| 80356982 | 69227 | NM_007294.3(BRCA1): c.2410C > T (p.Gln804Ter) | BRCA1 |
| 80357067 | 69840 | NM_007294.3(BRCA1): c.4339C > T (p.Gln1447Ter) | BRCA1 |
| 80357089 | 69512 | NM_007294.3(BRCA1): c.3331C > T (p.Gln1111Ter) | BRCA1 |
| 80357352 | 69958 | NM_007294.3(BRCA1): c.4810C > T (p.Gln1604Ter) | BRCA1 |

TABLE 34-continued

Disease Targets for Base Editing

| RS# | AlleleID | Name | GeneSymbol |
|---|---|---|---|
| 80357485 | 69485 | NM_007294.3(BRCA1): c.3286C > T (p.Gln1096Ter) | BRCA1 |
| 80359818 | 31157 | NM_006516.3(SLC2A1): c.376C > T (p.Arg126Cys) | SLC2A1 |
| 80359826 | 201142 | NM_006516.3(SLC2A1): c.988C > T (p.Arg330Ter) | SLC2A1 |
| 104894003 | 33314 | NM_001101.4(ACTB): c.547C > T (p.Arg183Trp) | ACTB |
| 104894261 | 31727 | NM_130799.2(MEN1): c.1579C > T (p.Arg527Ter) | MEN1 |
| 104894267 | 31731 | NM_130799.2(MEN1): c.1378C > T (p.Arg460Ter) | MEN1 |
| 104894364 | 27627 | NM_004985.4(KRAS): c.173C > T (p.Thr58Ile) | KRAS |
| 104894621 | 23472 | NM_000304.3(PMP22): c.215C > T (p.Ser72Leu) | PMP22 |
| 104894714 | 19826 | NM_181882.2(PRX): c.2857C > T (p.Arg953Ter) | PRX |
| 104894797 | 26321 | NM_004006.2(DMD): c.9568C > T (p.Arg3190Ter) | DMD |
| 111033297 | 53892 | NM_004004.5(GJB2): c.169C > T (p.Gln57Ter) | GJB2 |
| 111033538 | 17382 | NM_032601.3(MCEE): c.139C > T (p.Arg47Ter) | MCEE |
| 111687884 | 51571 | NM_000138.4(FBN1): c.643C > T (p.Arg215Ter) | FBN1 |
| 112901682 | 76366 | NM_001141945.2(ACTA2): c.115C > T (p.Arg39Cys) | ACTA2 |
| 114368325 | 38634 | NM_000782.4(CYP24A1): c.1186C > T (p.Arg396Trp) | CYP24A1 |
| 118192226 | 34614 | NM_172107.3(KCNQ2): c.1342C > T (p.Arg448Ter) | KCNQ2 |
| 118192251 | 34269 | NM_004519.3(KCNQ3): c.988C > T (p.Arg330Cys) | KCNQ3 |
| 118203427 | 58245 | NM_000368.4(TSC1): c.682C > T (p.Arg228Ter) | TSC1 |
| 118203434 | 58253 | NM_000368.4(TSC1): c.733C > T (p.Arg245Ter) | TSC1 |
| 118203542 | 57958 | NM_000368.4(TSC1): c.1525C > T (p.Arg509Ter) | TSC1 |
| 118203999 | 16285 | NM_024675.3(PALB2): c.2962C > T (p.Gln988Ter) | PALB2 |
| 118204429 | 15511 | NM_000035.4(ALDOB): c.178C > T (p.Arg60Ter) | ALDOB |
| 121907916 | 18505 | NM_000280.4(PAX6): c.607C > T (p.Arg203Ter) | PAX6 |
| 121908212 | 23527 | NM_001127221.1(CACNA1A): c.1997C > T (p.Thr666Met) | CACNA1A |
| 121908427 | 20365 | NM_133647.1(SLC12A6): c.3031C > T (p.Arg1011Ter) | SLC12A6 |
| 121908489 | 20807 | NM_003919.2(SGCE): c.289C > T (p.Arg97Ter) | SGCE |
| 121912708 | 33034 | NM_001182.4(ALDH7A1): c.328C > T (p.Arg110Ter) | ALDH7A1 |
| 121913344 | 151858 | NM_000546.5(TP53): c.916C > T (p.Arg306Ter) | TP53 |
| 121917784 | 27085 | NM_000136.2(FANCC): c.37C > T (p.Gln13Ter) | FANCC |
| 121918167 | 15995 | NM_000275.2(OCA2): c.2228C > T (p.Pro743Leu) | OCA2 |
| 121918244 | 16869 | NM_001023 570.3(IQCB1): c.1381C > T (p.Arg461Ter) | IQCB1 |
| 121918257 | 16926 | NM_000255.3(MMUT): c.322C > T (p.Arg108Cys) | MMUT |
| 122445105 | 26774 | NM_000489.4(ATRX): c.736C > T (p.Arg246Cys) | ATRX |
| 122445108 | 26781 | NM_000489.4(ATRX): c.109C > T (p.Arg37Ter) | ATRX |
| 122453121 | 26733 | NM_004484.3(GPC3): c.1159C > T (p.Arg387Ter) | GPC3 |
| 128626235 | 26264 | NM_004006.2(DMD): c.433C > T (p.Arg145Ter) | DMD |
| 137852897 | 17803 | NM_024312.4(GNPTAB): c.3565C > T (p.Arg1189Ter) | GNPTAB |
| 137852994 | 19999 | NM_018136.4(ASPM): c.9178C > T (p.Gln3060Ter) | ASPM |
| 137853229 | 21102 | NM_004260.3(RECQL4): c.2269C > T (p.Gln757Ter) | RECQL4 |
| 138049878 | 171163 | NM_000257.4(MYH7): c.2608C > T (p.Arg870Cys) | MYH7 |
| 138119149 | 39897 | NM_020745.3(AARS2): c.1774C > T (p.Arg592Trp) | AARS2 |
| 139675596 | 40180 | NM_023073.3(CPLANE1): c.7477C > T (p.Arg2493Ter) | CPLANE1 |
| 140511594 | 39892 | NM_024753.4(TTC21B): c.626C > T (p.Pro209Leu) | TTC21B |
| 143343083 | 169011 | NM_004004.5(GJB2): c.298C > T (p.His100Tyr) | GJB2 |
| 148865119 | 210450 | NM_000071.2(CBS): c.146C > T (p.Pro49Leu) | CBS |
| 180177091 | 132277 | NM_024675.3(PALB2): c.751C > T (p.Gln251Ter) | PALB2 |
| 199422209 | 33004 | NM_001127701.1(SERPINA1): c.1178C > T (p.Pro393Leu) | SERPINA1 |
| 199473556 | 78702 | NM_198056.2(SCN5A): c.361C > T (p.Arg121Trp) | SCN5A |
| 200075782 | 39327 | NM_003560.3(PLA2G6): c.109C > T (p.Arg37Ter) | PLA2G6 |
| 200287925 | 151917 | NM_002485.4(NBN): c.127C > T (p.Arg43Ter) | NBN |
| 200309328 | 176122 | NM_000138.4(FBN1): c.8080C > T (p.Arg2694Ter) | FBN1 |
| 200440128 | 205749 | NM_012160.4(FBXL4): c.64C > T (p.Arg22Ter) | FBXL4 |
| 201632198 | 55279 | NM_024022.2(TMPRSS3): c.325C > T (p.Arg109Trp) | TMPRSS3 |
| 267606919 | 21912 | NM_004646.3(NPHS1): c.3478C > T (p.Arg1160Ter) | NPHS1 |
| 267607143 | 20038 | NM_021625.4(TRPV4): c.943C > T (p.Arg315Trp) | TRPV4 |
| 267607258 | 46918 | NM_002437.5(MPV17): c.293C > T (p.Pro98Leu) | MPV17 |
| 375699023 | 223602 | NM_024675.3(PALB2): c.1042C > T (p.Gln348Ter) | PALB2 |
| 387906799 | 39125 | NM_001244008.1(KIF1A): c.296C > T (p.Thr99Met) | KIF1A |
| 387906904 | 39429 | NM_021625.4(TRPV4): c.694C > T (p.Arg232Cys) | TRPV4 |
| 387907329 | 51081 | NM_007075.3(WDR45): c.700C > T (p.Arg234Ter) | WDR45 |
| 397507215 | 46080 | NM_007294.3(BRCA1): c.3352C > T (p.Gln1118Ter) | BRCA1 |
| 397507447 | 47625 | NM_024312.4(GNPTAB): c.1123C > T (p.Arg375Ter) | GNPTAB |
| 397509002 | 69322 | NM_007294.3(BRCA1): c.2713C > T (p.Gln905Ter) | BRCA1 |
| 397509151 | 69806 | NM_007294.3(BRCA1): c.4201C > T (p.Gln1401Ter) | BRCA1 |
| 397509330 | 70405 | NM_007294.3(BRCA1): c.850C > T (p.Gln284Ter) | BRCA1 |
| 397514477 | 40113 | NM_001031726.3(C19orf12): c.32C > T (p.Thr11Met) | C19orf12 |
| 397515848 | 51592 | NM_000138.4(FBN1): c.7180C > T (p.Arg2394Ter) | FBN1 |
| 397516463 | 52805 | NM_001001430.2(TNNT2): c.388C > T (p.Arg130Cys) | TNNT2 |
| 398123061 | 76995 | NM_012160.4(FBXL4): c.1444C > T (p.Arg482Trp) | FBXL4 |
| 398123168 | 98367 | NM_000143.3(FH): c.952C > T (p.His318Tyr) | FH |
| 398123832 | 100328 | NM_004006.2(DMD): c.10171C > T (p.Arg3391Ter) | DMD |
| 398123929 | 100476 | NM_004006.2(DMD): c.3151C > T (p.Arg1051Ter) | DMD |
| 398124478 | 102281 | NM_138694.3(PKHD1): c.2341C > T (p.Arg781Ter) | PKHD1 |
| 536907995 | 137626 | NM_007194.4(CHEK2): c.58C > T (p.Gln20Ter) | CHEK2 |
| 587776407 | 153707 | NM_024675.3(PALB2): c.451C > T (p.Gln151Ter) | PALB2 |
| 587776935 | 48413 | NM_005465.4(AKT3): c.1393C > T (p.Arg465Trp) | AKT3 |

TABLE 34-continued

Disease Targets for Base Editing

| RS# | AlleleID | Name | GeneSymbol |
|---|---|---|---|
| 587780062 | 133253 | NM_000535.5(PMS2): c.823C > T (p.Gln275Ter) | PMS2 |
| 587780226 | 133611 | NM_032043.2(BRIP1): c.1315C > T (p.Arg439Ter) | BRIP1 |
| 587781948 | 151416 | NM_000465.3(BARD1): c.1921C > T (p.Arg641Ter) | BARD1 |
| 587783685 | 168920 | NM_003482.3(KMT2D): c.12592C > T (p.Arg4198Ter) | KMT2D |
| 587784339 | 169779 | NM_003560.3(PLA2G6): c.1903C > T (p.Arg635Ter) | PLA2G6 |
| 724159971 | 172085 | NM_152778.2(MFSD8): c.1444C > T (p.Arg482Ter) | MFSD8 |
| 727503504 | 176073 | NM_000363.4(TNNI3): c.508C > T (p.Arg170Trp) | TNNI3 |
| 727503513 | 172503 | NM_001001430.2(TNNT2): c.280C > T (p.Arg94Cys) | TNNT2 |
| 727504136 | 177069 | NM_001165963.1(SCN1A): c.3733C > T (p.Arg1245Ter) | SCN1A |
| 730881422 | 179951 | NM_000465.3(BARD1): c.1996C > T (p.Gln666Ter) | BARD1 |
| 730882029 | 180988 | NM_000546.5(TP53): c.1024C > T (p.Arg342Ter) | TP53 |
| 747604569 | 185305 | NM_032043.2(BRIP1): c.484C > T (p.Arg162Ter) | BRIP1 |
| 750621215 | 184806 | NM_002878.3(RAD51D): c.898C > T (p.Arg300Ter) | RAD51D |
| 753330544 | 195505 | NM_206933.2(USH2A): c.13316C > T (p.Thr4439Ile) | USH2A |
| 761494650 | 185659 | NM_007194.4(CHEK2): c.85C > T (p.Gln29Ter) | CHEK2 |
| 763091520 | 197655 | NM_000138.4(FBN1): c.6169C > T (p.Arg2057Ter) | FBN1 |
| 768933093 | 226933 | NM_024685.4(BBS10): c.145C > T (p.Arg49Trp) | BBS10 |
| 773770609 | 264863 | NM_177550.4(SLC13A5): c.997C > T (p.Arg333Ter) | SLC13A5 |
| 778989252 | 236615 | NM_007194.4(CHEK2): c.1315C > T (p.Gln439Ter) | CHEK2 |
| 786202064 | 184902 | NM_007294.3(BRCA1): c.4834C > T (p.Gln1612Ter) | BRCA1 |
| 786203821 | 184272 | NM_024675.3(PALB2): c.940C > T (p.Gln314Ter) | PALB2 |
| 794726710 | 187772 | NM_001165963.1(SCN1 A): c.3637C > T (p.Arg1213Ter) | SCN1A |
| 794726730 | 187817 | NM_001165963.1(SCN1A): c.2134C > T (p.Arg712Ter) | SCN1A |
| 794728195 | 197755 | NM_000138.4(FBN1): c.2645C > T (p.Ala882Val) | FBN1 |
| 796051885 | 199890 | NM_003239.4(TGFB3): c.898C > T (p.Arg300Trp) | TGFB3 |
| 797044883 | 205286 | NM_019066.4(MAGEL2): c.1912C > T (p.Gln638Ter) | MAGEL2 |
| 869312892 | 226683 | NM_139276.2(STAT3): c.2147C > T (p.Thr716Met) | STAT3 |
| 876658461 | 232175 | NM_003000.2(SDHB): c.640C > T (p.Gln214Ter) | SDHB |
| 886037684 | 248861 | NM_177438.2(DICER1): c.2062C > T (p.R688*) | DICER1 |
| 886038001 | 249129 | NM_007294.3(BRCA1): c.2599C > T (p.Gln867Ter) | BRCA1 |
| 886039480 | 260102 | NM_024675.3(PALB2): c.2368C > T (p.Gln790Ter) | PALB2 |
| 886040218 | 261660 | NM_007294.3(BRCA1): c.4225C > T (p.Gln1409Ter) | BRCA1 |
| 886041222 | 264422 | NM_000280.4(PAX6): c.781C > T (p.Arg261Ter) | PAX6 |
| 1057521083 | 366251 | NM_015265.3(SATB2): c.1165C > T (p.Arg389Cys) | SATB2 |

Example 6: Demonstration of Gene Editing Activity in Plant Cells

Base-editing activity of an RGN-deaminase fusion protein of the invention is demonstrated in plant cells using protocols adapted from Li, et al., 2013 (*Nat. Biotech.* 31:688-691). Briefly, an expression vector comprising an expression cassette capable of expressing in plant cells an RGN-deaminase fusion protein operably linked to a SV40 nuclear localization signal (SEQ ID NO: 43) and a second expression cassette encoding a guide RNA targeting one or more sites in the plant PDS gene that flank an appropriate PAM sequence are introduced into *Nicotiana benthamiana* mesophyll protoplasts using PEG-mediated transformation. The transformed protoplasts are incubated in the dark for up to 36 hr. Genomic DNA is isolated from the protoplasts using a DNeasy Plant Mini Kit (Qiagen). The genomic region flanking the RGN target site is PCR amplified, products are purified, and the purified PCR products are analyzed using Next Generation Sequencing on Illumina MiSeq. Typically, 100,000 of 250 bp paired-end reads (2×100,000 reads) are generated per amplicon. The reads are analyzed using CRISPResso (Pinello, et al. 2016 *Nature Biotech,* 34:695-697) to calculate the rates of editing. Output alignments are analyzed for INDEL formation or introduction of specific adenine mutations.

Example 7: Testing mRNA Delivery

To determine if the base editors are capable of delivery in different formats, mRNA delivery was tested with primary T-cells. Purified CD3+ T-cells or PBMCs were thawed, activated using CD3/CD28 beads (ThermoFisher) for 3 days, then nucleofected using the Lonza 4D-Nucleofector X unit and Nucleocuvette strips. The P3 Primary Cell kit was used for both mRNA and RNP delivery. Cells were transfected using the EO-115 and EH-115 programs for mRNA and RNP delivery respectively. Cells were cultured in CTS OpTimizer T cell expansion medium (ThermoFisher) containing IL-2, IL-7, and IL-15 (Miltenyi Biotec) for 4 days post nucleofection before being harvested using a Nucleo-spin Tissue genomic DNA isolation kit (Machery Nagel).

Amplicons surrounding the editing sites were generated by PCR using primers identified in Table 35 and subjected to NGS sequencing using the Illumina Nexterra platform using 2×250 bp paired end sequencing. The estimated base editing rate was determined by calculating the overall substitution rate for each sample. The average and number of samples for each guide tested are shown below.

TABLE 35

| Average Editing rate for LPG50148-nAPG07433.1 via mRNA delivery | | |
|---|---|---|
| SGN | Average % Edit | N |
| SGN002352 | 7.84 | 2 |
| SGN002364 | 29.79 | 2 |
| SGN002367 | 0.1 | 2 |
| SGN001061 | 0.37 | 1 |
| SGN001062 | 71.81 | 1 |
| SGN001064 | 3.99 | 1 |
| SGN002254 | 8.92 | 2 |
| SGN002255 | 5.26 | 2 |

TABLE 35-continued

Average Editing rate for LPG50148-
nAPG07433.1 via mRNA delivery

| SGN | Average % Edit | N |
|---|---|---|
| SGN002256 | 8.32 | 2 |
| SGN002290 | 2.88 | 2 |
| SGN002293 | 9.68 | 2 |
| SGN002299 | 27.05 | 2 |
| SGN002132 | 29.11 | 2 |
| SGN002137 | 7.77 | 2 |
| SGN002139 | 6.00 | 2 |
| SGN001770 | 1.22 | 2 |
| SGN001773 | 0.49 | 2 |
| SGN002212 | 29.63 | 2 |

TABLE 35-continued

Average Editing rate for LPG50148-
nAPG07433.1 via mRNA delivery

| SGN | Average % Edit | N |
|---|---|---|
| SGN002216 | 2.58 | 2 |
| SGN002218 | 36.13 | 2 |
| SGN002230 | 14.32 | 2 |
| SGN002231 | 33.18 | 2 |
| SGN000753 | 6.84 | 2 |
| SGN000754 | 26.41 | 1 |
| SGN001856 | 0.5 | 2 |
| SGN002248 | 9.91 | 2 |
| SGN002249 | 40.19 | 2 |

SEQUENCE LISTING (564 sequences)

SEQ ID NO: 1 - protein, 169 aa, Artificial Sequence
  source: /note="Description of Artificial Sequence: Synthetic polypeptide"
  source: /note="APG09982 protein sequence"
MSDLELNHEYWMRHALQLAKRARDEGEVPVGAVLVLNNQVIGEGWNRAIGLHDPTAHAEIMALRQGGLVLQNYRLYDTTLYSTFEPCVMCSGAMVHSRIGTLVFGVRNEKTGAAGSLMDVLRHPGMNHQVQIIDGVLAPECSGLLCRFFRMPRRVFNQQKAESTSSPGD

SEQ ID NO: 2 - protein, 164 aa, Artificial Sequence
  source: /note="Description of Artificial Sequence: Synthetic polypeptide"
  source: /note="APG03724 protein sequence"
MSNPELTHEHWMRYALTLAKRAREEGEVPVGAVLVLNNQVIGEGWNRAIGLHDPTAHAEIMALRQGGLVLQNYRLYDTTLYSTFEPCVMCAGAMVHSRIGQLVFGVRNAKTGAAGSLMDVLHHPGMNHRIEFTEGVLRDECAAMLCRFFRQPRRVFNALKTGNA

SEQ ID NO: 3 - protein, 169 aa, Artificial Sequence
  source: /note="Description of Artificial Sequence: Synthetic polypeptide"
  source: /note="APG09949 protein sequence"
MSIPELNHDVWMRHALTLAKRAREEGEVPVGAVLVLNGQVIGEGWNRAIGLHDPTAHAEIMALRQGGLVLQNYRLYDTTLYSTFEPCVMCAGAMVHSRIGQLVFGVRNAKTGAAGSLIDVLHHPGMNHRVAITEGVLREECAAMLCRFFRQPRRVFNALKKPAGDPTAF

SEQ ID NO: 4 - protein, 172 aa, Artificial Sequence
  source: /note="Description of Artificial Sequence: Synthetic polypeptide"
  source: /note="APG08196 protein sequence"
MSNPELNHEYWMRYALTLAKRARDEGEVPVGAVLVLNDQVIGEGWNRAIGLHDPTAHAEIMALRQGGLVLQNYRLYDTTLYSTFEPCVMCAGAMVHSRIGRLVFGVRNAKTGAAGSLLDVLHHPGMNHHIEMEEGVLRDECAAMLCRFFRQPRRVFNALKKSPPDSPNLQAR

SEQ ID NO: 5 - protein, 169 aa, Artificial Sequence
  source: /note="Description of Artificial Sequence: Synthetic polypeptide"
  source: /note="APG06333 protein sequence"
MSNPELTHDHWMRHALTLAQRARNEGEVPVGAVLVLNGQVIGEGWNRAIGLHDPTAHAEIMALRQGGLVLQNYRLYDTVLYSTFEPCVMCAGAMVHSRIGQLVFGVRNAKTGAAGSLIDVLHHPGMNHRVEIIEGVLRDECAAMLCRFFRHPRRVFNALKKNAGTSPTQ

SEQ ID NO: 6 - protein, 166 aa, Artificial Sequence
  source: /note="Description of Artificial Sequence: Synthetic polypeptide"
  source: /note="APG06489 protein sequence"
MSDTELNHEYWMRHALMLAKRARDEGEVPVGAVLVLKNQVIGEGWNRAIGLHDPTAHAEIMALRQGGLVLQNYRLYDTTLYSTFEPCVMCAGAMVHSRIGNLVFGVRNAKTGAAGSLIDVLHHPGMNHRVEIAEGVLADECSAMLCRFFRHPRRVFNALKQAAKHD

SEQ ID NO: 7 - protein, 171 aa, Artificial Sequence
  source: /note="Description of Artificial Sequence: Synthetic polypeptide"
  source: /note="APG08449 protein sequence"
MSDIELNHEYWMRHALMLAKRAREEGEVPVGAVLVLNNQVIGEGWNRAIGLHDPTAHAEIMALRQGGLVLQNYRLYDTTLYSTFEPCVMCAGAMVHSRIGHLVFGVRNAKTGAAGSLIDVLHHPGMNHRIEFTEGVLADECSGMLCRFFRYPRRVFNTLKQAAKANPPAAQ

SEQ ID NO: 8 - protein, 173 aa, Artificial Sequence
  source: /note="Description of Artificial Sequence: Synthetic polypeptide"
  source: /note="APG05174 protein sequence"
MSIPELNHDVWMRHALTLAKRAREEGEVPVGAVLVLNGQVIGEGWNRAIGLHDPTAHAEIMALRQGGLVLQNYRLYDTTLYSTFEPCVMCAGAMVHSRIGQLVFGVRNAKTGAAGSLMDVLHHPGMNHRVEITEGVLRDECAAMLCRFFRQPRRVFNALKKPAGDPSALQNNR

SEQ ID NO: 9 - protein, 168 aa, Artificial Sequence
  source: /note="Description of Artificial Sequence: Synthetic polypeptide"
  source: /note="APG09102 protein sequence"
MSNPEFTHEYWMRHALTLARRARDEGEVPVGAVLVLNNQVIGEGWNRAIGLHDPTAHAEIMALRQGGLVLQNYRLYDTTLYSTFEPCVMCSGAMVHSRIGTLVFGVRNEKTGAAGSLMDVLGHPGMNHQVKTIGGVLAPECSGLLCRFFRMPRRVFNQQKAELKSSGD

SEQ ID NO: 10 - protein, 167 aa, Artificial Sequence
  source: /note="Description of Artificial Sequence: Synthetic polypeptide"
  source: /note="APG05723 protein sequence"
MSDAELTHEYWMRHALTLAQRARDEGEVPVGAVLVLNNQVIGEGWNRAIGLHDPTAHAEIMALRQGGLVQQNYRLYDTTLYSTFEPCVMCAGAMVHSRIGRLIFGVRNAKTGAAGSLIDVLHHPGMNHRVEVVEGILRDECAGMLCRFFRQPRRVFNALKKGATDVL

SEQ ID NO: 11 - DNA, 507 bp, Artificial Sequence
  source: /note="Description of Artificial Sequence: Synthetic polynucleotide"
  source: /note="mammalian codon optimized APG09982"
atgagcgacctggaactgaatcacgagtactggatgagacacgccctgcagctggccaagcgggccagagatgagggcgaggtgcccgtgggcgctgtgctggtcctgaacaaccaggtgatcggcgaaggctggaacagagccattggactgcatgacccaacagcccacgccgaaatcatggccctgcggcagggcggcctggtgctgcaaaattaccggctgtacgacaccaccctgtatagcacattcgagccctgcgtgatgtgctctggtgctatggtgcacagcagaatcggaaccctggtgtttggcgtgcggaacgagaagaccggcgccgctggcagcctgatggacgtgctgaggcatcctggaatgaaccaccaggttcagatcatcgacggcgtgctcgcccctgagtgttctggcctgctgtgccggttcttcagaatgcctagaagagtgttcaaccagcagaaagccgaatccaccagcagccctggcgac

SEQ ID NO: 12 - DNA, 492 bp, Artificial Sequence
  source: /note="Description of Artificial Sequence: Synthetic polynucleotide"
  source: /note="mammalian codon optimized APG03724"
atgagcaaccccgagctgacccacgagcactggatgcggtacgccctgacactggccaagcgggccagagaggaaggagaagtgccagtgggcgccgtgctggtcctcaacaaccaggtgatcggcgaaggctggaatagagccatcggcctgcatgatcctacagcccacgccgaaatcatggccctgagacagggcggcctggtgctgcagaattacagactgtatgacaccaccctgtactccaccttcgagccttgtgtgatgtgcgccggagctatggtgcactctagaatcggccagctggttttcggcgtgcggaacgctaaaaccggcgctgctggcagcctgatggacgtgctgcatcaccccggcatgaaccacagaatcgagttcaccgagggagtgctgcgcgacgagtgcgccgccatgctgtgccggttcttccggcaacctagaagggtgtttaacgccctgaagacaggcaacgcc

SEQ ID NO: 13 - DNA, 507 bp, Artificial Sequence
  source: /note="Description of Artificial Sequence: Synthetic polynucleotide"
  source: /note="mammalian codon optimized  APG09949"
atgagcatccccgagctgaatcacgatgtttggatgcggcacgccctgaccctggccaaaagagccagagaggaaggcgaggtgcctgtgggtgccgtgctggtgctgaacggccaggtgatcggagaaggctggaatagagccattggactgcatgatcctacagcccacgctgaaatcatggccctgagacagggcggcctggtcctccagaactacagactgtacgacaccaccctgtactctaccttcgagccttgcgtgatgtgcgccggcgccatggtgcactccagaatcggccagctggtgttcggcgtgcggaacgccaagacaggcgctgctggcagcctgatcgacgtgctgcatcaccctggcatgaaccacagggtggccatcaccgagggagtgctgcgggaagagtgcgccgccatgctgtgtagattcttcagacaacctagacgggtcttcaacgccctgaagaagccagctggcgaccccacagccttt

SEQ ID NO: 14 - DNA, 516 bp, Artificial Sequence
  source: /note="Description of Artificial Sequence: Synthetic polynucleotide"
  source: /note="mammalian codon optimized APG08196"
atgagcaaccccgagctgaatcacgagtactggatgcggtacgccctgacactggccaagcgggctcgggacgagggcgaagtgcccgtgggagccgtgctggtgctgaacgaccaggtgatcggagaaggatggaatagagccatcggcctgcatgaccccaccgcccacgccgagatcatggccctgcgccagggcggcctggttctccagaactacaggctgtacgacacaaccctgtattccaccttcgagccttgtgtgatgtgcgccggcgccatggtgcacagcagaatcggcagactggtctttggcgtgcggaacgccaagaccggcgctgctggcagcctgctggacgtgctgcatcaccctggcatgaaccaccacatcgagatggaagaaggcgtgctgagagatgagtgcgccgctatgctgtgccggttcttcagacaacctagaagagtgttcaacgccctgaagaaatctccacctgatagccctaatctgcaggccaga

SEQ ID NO: 15 - DNA, 507 bp, Artificial Sequence
  source: /note="Description of Artificial Sequence: Synthetic polynucleotide"
  source: /note=" mammalian codon optimized APG06333"
atgagcaaccctgagctgacacacgaccactggatgcggcacgctctgaccctggcccagcgcgctagaaacgagggagaagtgcctgtgggcgccgtgctggttctgaacggccaagtgatcggagagggctggaatcgggccatcggcctgcatgaccctacagcccacgccgagattatggccctgagacagggcggcctggtgctgcagaactacagactgtacgacaccgtgctctacagcaccttcgagccttgcgtgatgtgcgccggcgctatggtccactctagaatcggccagctggtctttggcgtgcggaatgccaagacaggcgccgccggcagcctgatcgacgtgcttcatcaccccggaatgaaccacagagtggaaatcatcgagggcgtgctgcgggatgaatgtgccgctatgctgtgccggttcttcagacacccaagaagggtgttcaacgccctgaaaaagaacgccggcaccagccccacccag

SEQ ID NO: 16 - DNA, 498 bp, Artificial Sequence
  source: /note="Description of Artificial Sequence: Synthetic polynucleotide"
  source: /note="mammalian codon optimized APG06489"
atgagcgacaccgagctgaaccacgagtactggatgcggcacgccctgatgctggctaagcgggccagagatgagggcgaagtgcccgtgggcgccgtgctggtcctgaagaaccaggttatcggagaaggctggaatagagccatcggcctgcatgaccctacagcccacgccgagattatggccctgagacaaggcggcctggtgctgcagaactacagactgtacgacacaaccctgtattccaccttcgagccttgtgtgatgtgcgccggcgccatggtgcactctagaatcggcaatctggtgttcggcgtgcggaacgccaagaccggcgctgctggcagcctgatcgacgtgctccatcaccctggaatgaaccacagagtggaaatcgccgaaggagtgctggccgacgaatgcagcgccatgctgtgccggttcttcagacacccaaggcgggtgtttaacgccctgaaacaggccgctaagcacgac

SEQ ID NO: 17 - DNA, 513 bp, Artificial Sequence
  source: /note="Description of Artificial Sequence: Synthetic polynucleotide"
  source: /note="mammalian codon optimized APG08449"
atgtctgatatcgagctgaatcacgagtactggatgcggcacgccctgatgctggccaagcgggccagagaggaaggcgaagtgccagtgggcgccgtgctggtgctgaacaaccaggtgatcggagaaggctggaatagagccatcggcctgcatgatcctaccgcccacgccgagatcatggccctgagacagggcggactggtgctgcagaactaccggctgtacgacaccaccctgtacagcacattcgagccttgtgtgatgtgcgccggagccatggtgcacagcagaatcggccacctggtttttggcgtgcggaacgccaagaccggcgctgctggcagcctgatcgacgtcctgcatcaccctggcatgaaccacagaattgaattcacagagggcgtgctcgccgacgagtgctccggcatgctgtgccggttcttcagatatcctagaagggtgttcaacaccctgaagcaggccgctaaagccaacccccccgccgctcaa

SEQ ID NO: 18 - DNA, 519 bp, Artificial Sequence
  source: /note="Description of Artificial Sequence: Synthetic polynucleotide"
  source: /note="mammalian codon optimized APG05174"
atgtctatccctgagctgaaccacgatgtgtggatgcggcacgccctgacactggccaagcgggccagagaagagggagaagtgccagtgggcgccgtgctggtgctgaatggccaggtgatcggcgaaggctggaacagagccatcggcctgcatgaccctaccgcccacgccgagattatggccctgcggcagggcggactggtcctgcaaaattacagactgtacgacaccacactgtacagcacctttgagccttgtgtgatgtgcgccggcgctatggtgcacagcagaatcggacagctggttttcggagtgcggaacgccaaaaccggcgccgctggctccctgatggacgtgctgcatcaccccggcatgaaccatagagtggaaatcaccgagggcgtcctcagagatgagtgcgctgctatgctgtgccggttcttcagacagcctagacgcgtgttcaacgccctgaagaagcctgccggcgaccccagcgccctgcagaacaaccgg

SEQ ID NO: 19 - DNA, 504 bp, Artificial Sequence
  source: /note="Description of Artificial Sequence: Synthetic polynucleotide"
  source: /note="mammalian codon optimized APG09102"
atgagcaaccccgaattcacccacgagtactggatgcggcacgccctgacactggctagaagggcccgggacgagggcgaggtgccagtgggcgccgtgctggtgctgaacaaccaggtgatcggagaaggctggaatagagccatcggcctgcatgatcctacagcccacgccgaaatcatggccctgagacagggcggcctggtgctgcagaactaccggctgtacgacaccacactgtatagcaccttcgagccttgcgtgatgtgtagcggagctatggtgcacagcagaatcggcaccctggttttcggcgtgcggaacgagaagaccggcgccgctggctctctgatggacgtgctcggccaccccggcatgaaccaccaggtcaagaccatcggcggagtgctggcccctgaatgtagcggcctgctgtgccggttcttcagaatgcctagaagagtgtttaatcaacagaaagccgagctgaagtcttccggagat

SEQ ID NO: 20 - DNA, 501 bp, Artificial Sequence
  source: /note="Description of Artificial Sequence: Synthetic polynucleotide"
  source: /note="mammalian codon optimized APG05723"
atgagcgacgccgagctgacacacgagtactggatgcggcacgccctgaccctggcccagcgcgccagagatgagggagaagtgcctgtgggcgccgtgctggtgctgaacaaccaggtgatcggcgaaggctggaatagagccatcggactgcatgaccccaccgcccacgctgaaatcatggccctgagacagggcggcctggtccagcagaactacagactgtacgacaccaccctgtattccaccttcgagccttgtgtgatgtgcgccggagctatggtgcacagcagaatcggcagactgattttcggcgtgcggaacgccaagacaggcgccgctggatctctgatcgacgtgctccatcaccccggcatgaaccacagagttgaggtggtggaaggcatcctgcgggacgagtgcgccggcatgctgtgccggttcttcagacaacctaggcgggtctttaacgccctgaagaaaggcgctacagatgtgctg

SEQ ID NO: 21 - DNA, 25 bp, Artificial Sequence
  source: /note="Description of Artificial Sequence: Synthetic oligonucleotide"
  source: /note="SGN000930 target sequence"
gaacaactcaaatggaaatgaatat

SEQ ID NO: 22 - DNA, 20 bp, Artificial Sequence
  source: /note="Description of Artificial Sequence: Synthetic oligonucleotide"
  source: /note="SGN000186 target sequence"
ggacagtgcgcatctccctg

SEQ ID NO: 23 - DNA, 20 bp, Artificial Sequence
  source: /note="Description of Artificial Sequence: Synthetic oligonucleotide"
  source: /note="SGN000194 target sequence"
gccgcacagcattcaggtcg

SEQ ID NO: 24 - DNA, 20 bp, Artificial Sequence
  source: /note="Description of Artificial Sequence: Synthetic oligonucleotide"
  source: /note="SGN000143 target sequence"
catggcagtacattagagca

SEQ ID NO: 25 - DNA, 20 bp, Artificial Sequence
  source: /note="Description of Artificial Sequence: Synthetic oligonucleotide"
  source: /note="SGN000139 target sequence"
aggttttaatggcccagcct

SEQ ID NO: 26 - RNA, 135 nt, Artificial Sequence
  source: /note="Description of Artificial Sequence: Synthetic polynucleotide"
  source: /note="SGN000930 sgRNA sequence"
gaacaacucaaauggaaaugaauaugucauaguuccaugaaagccaaaaguggcuuugauguuucuaugauaaggguuucggcccguggcgucggggaucgccugcccauuccgaugggcuucuccccauuuauu

SEQ ID NO: 27 - RNA, 130 nt, Artificial Sequence
  source: /note="Description of Artificial Sequence: Synthetic polynucleotide"
  source: /note="SGN000186 sgRNA sequence"
ggacagugcgcaucucccuggucauaguuccauuaaagccaaaaguggcuuugauguuucuaugauaaggguuucgacccguggcgucggggaucgccugcccauugaaaugggcuucuccccauuuauu

SEQ ID NO: 28 - RNA, 130 nt, Artificial Sequence
  source: /note="Description of Artificial Sequence: Synthetic polynucleotide"
  source: /note="SGN000194 sgRNA sequence"
gccgcacagcauucaggucggucauaguuccauuaaagccaaaaguggcuuugauguuucuaugauaaggguuucgacccguggcgucggggaucgccugcccauugaaaugggcuucuccccauuuauu

SEQ ID NO: 29 - RNA, 130 nt, Artificial Sequence
  source: /note="Description of Artificial Sequence: Synthetic polynucleotide"
  source: /note="SGN000143 sgRNA sequence"
cauggcaguacauuagagcagucauaguuccauuaaagccaaaaguggcuuugauguuucuaugauaaggguuucgacccguggcgucggggaucgccugcccauugaaaugggcuucuccccauuuauu

SEQ ID NO: 30 - RNA, 130 nt, Artificial Sequence
  source: /note="Description of Artificial Sequence: Synthetic polynucleotide"
  source: /note="SGN000139 sgRNA sequence"
agguuuuaauggcccagccugucauaguuccauuaaagccaaaaguggcuuugauguuucuaugauaaggguuucgacccguggcgucggggaucgccugcccauugaaaugggcuucuccccauuuauu

SEQ ID NO: 31 - DNA, 20 bp, Artificial Sequence
  source: /note="Description of Artificial Sequence: Synthetic oligonucleotide"
  source: /note="SGN000930 FWD primer"
gacagccaagaggttttgcc

SEQ ID NO: 32 - DNA, 20 bp, Artificial Sequence
  source: /note="Description of Artificial Sequence: Synthetic oligonucleotide"
  source: /note="SGN000930 REV primer"
ctgtcccttgcagcttctgt

SEQ ID NO: 33 - DNA, 20 bp, Artificial Sequence
  source: /note="Description of Artificial Sequence: Synthetic oligonucleotide"
  source: /note="SGN000186 FWD primer"
tggcccctatgtggagatca

SEQ ID NO: 34 - DNA, 20 bp, Artificial Sequence
  source: /note="Description of Artificial Sequence: Synthetic oligonucleotide"
  source: /note="SGN000186 REV primer"
ggcagagctcagcctcatag

SEQ ID NO: 35 - DNA, 20 bp, Artificial Sequence
  source: /note="Description of Artificial Sequence: Synthetic oligonucleotide"
  source: /note="SGN000194 FWD primer"
atgacattcaggccacagtg

SEQ ID NO: 36 - DNA, 20 bp, Artificial Sequence
  source: /note="Description of Artificial Sequence: Synthetic oligonucleotide"
  source: /note="SGN000194 REV primer"
cttcctcctattcaggccca

SEQ ID NO: 37 - DNA, 19 bp, Artificial Sequence
  source: /note="Description of Artificial Sequence: Synthetic oligonucleotide"
  source: /note="SGN000143 FWD primer"
acatttgacgagcagcgaa

SEQ ID NO: 38 - DNA, 22 bp, Artificial Sequence
  source: /note="Description of Artificial Sequence: Synthetic oligonucleotide"
  source: /note="SGN000143 REV primer"
agggcccctggagaggttttaa

SEQ ID NO: 39 - DNA, 20 bp, Artificial Sequence
  source: /note="Description of Artificial Sequence: Synthetic oligonucleotide"
  source: /note="SGN000139 FWD primer"
cttgtagctggaggtccatc

SEQ ID NO: 40 - DNA, 20 bp, Artificial Sequence
  source: /note="Description of Artificial Sequence: Synthetic oligonucleotide"
  source: /note="SGN000139 REV primer"
tgttggcaaatctagtctcg

SEQ ID NO: 41 - protein, 1071 aa, Bacillus sp.
  source: /note="Bacillus sp. APG07433.1"
MRELDYRIGLDIGTNSIGWGVIELSWNKDRERYEKVRIVDQGVRMFDRAEMPKTGASLAEPRRIARSSRRRLNRKSQRKKNIRNLLVQHGVITQEELDSLYPLSKKSMDIWGIRLDGLDRLLNHFEWARLLIHLAQRRGFKSNRKSELKDTETGKVLSSIQLNEKRLSLYRTVGEMWMKDPDFSKYDRKRNSPNEYVFSVSRAELEKEIVTLFAAQRRFQSPYASKDLQETYLQIWTHQLPFASGNAILNKVGYCSLLKGKERRIPKATYTFQYFSALDQVNRTRLGPDFQPFTKEQREIILNNMFQRTDYYKKKTIPEVTYYDIRKWLELDETIQFKGLNYDPNEELKKIEKKPFINLKAFYEINKVVANYSERTNETFSTLDYDGIGYALTVYKTDKDIRSYLKSSHNLPKRCYDDQLIEELLSLSYTKFGHLSLKAINHVLSIMQKGNTYKEAVDQLGYDTSGLKKEKRSKFLPPISDEITNPIVKRALTQARKVVNAIIRRHGSPHSVHIELARELSKNHDERTKIVSAQDENYKKNKGAISILSEHGILNPTGYDIVRYKLWKEQGERCAYSLKEIPADTFFNELKKERNGAPILEVDHILPYSQSFIDSYHNKVLVYSDENRKKGNRIPYTYFLETNKDWEAFERYVRSNKFFSKKKREYLLKRAYLPRESELIKERHLNDTRYASTFLKNFIEQNLQFKEAEDNPRKRRVQTVNGVITAHFRKRWGLEKDRQETYLHHAMDAIIVACTDHHMVTRVTEYYQIKESNKSVKKPYFPMPWEGFRDELLSHLASQPIAKKISEELKAGYQSLDYIFVSRMPKRSITGAAHKQTIMRKGGIDKKGKTIIIERLHLKDIKFDENGDFKMVGKEQDMATYEAIKQRYLEHGKNSKKAFETPLYKPSKKGTGNLIKRVKVEGQAKSFVREVNGGVAQNGDLVRVDLFEKDDKYYMVPIYVPDTVCSELPKKVVASSKGYEQWLTLDNSFTFKFSLYPYDLVRLVKGDEDRFLYFGTLDIDSDRLNFKDVNKPSKKNEYRYSLKTIEDLEKYEVGVLGDLRLVRKETRRNFH

SEQ ID NO: 42 - protein, 1071 aa, Artificial Sequence
  source: /note="Description of Artificial Sequence: Synthetic polypeptide"
  source: /note="nAPG07433.1"
MRELDYRIGLAIGTNSIGWGVIELSWNKDRERYEKVRIVDQGVRMFDRAEMPKTGASLAEPRRIARSSRRRLNRKSQRKKNIRNLLVQHGVITQEELDSLYPLSKKSMDIWGIRLDGLDRLLNHFEWARLLIHLAQRRGFKSNRKSELKDTETGKVLSSIQLNEKRLSLYRTVGEMWMKDPDFSKYDRKRNSPNEYVFSVSRAELEKEIVTLFAAQRRFQSPYASKDLQETYLQIWTHQLPFASGNAILNKVGYCSLLKGKERRIPKATYTFQYFSALDQVNRTRLGPDFQPFTKEQREIILNNMFQRTDYYKKKTIPEVTYYDIRKWLELDETIQFKGLNYDPNEELKKIEKKPFINLKAFYEINKVVANYSERTNETFSTLDYDGIGYALTVYKTDKDIRSYLKSSHNLPKRCYDDQLIEELLSLSYTKFGHLSLKAINHVLSIMQKGNTYKEAVDQLGYDTSGLKKEKRSKFLPPISDEITNPIVKRALTQARKVVNAIIRRHGSPHSVHIELARELSKNHDERTKIVSAQDENYKKNKGAISILSEHGILNPTGYDIVRYKLWKEQGERCAYSLKEIPADTFFNELKKERNGAPILEVDHILPYSQSFIDSYHNKVLVYSDENRKKGNRIPYTYFLETNKDWEAFERYVRSNKFFSKKKREYLLKRAYLPRESELIKERHLNDTRYASTFLKNFIEQNLQFKEAEDNPRKRRVQTVNGVITAHFRKRWGLEKDRQETYLHHAMDAIIVACTDHHMVTRVTEYYQIKESNKSVKKPYFPMPWEGFRDELLSHLASQPIAKKISEELKAGYQSLDYIFVSRMPKRSITGAAHKQTIMRKGGIDKKGKTIIIERLHLKDIKFDENGDFKMVGKEQDMATYEAIKQRYLEHGKNSKKAFETPLYKPSKKGTGNLIKRVKVEGQAKSFVREVNGGVAQNGDLVRVDLFEKDDKYYMVPIYVPDTVCSELPKKVVASSKGYEQWLTLDNSFTFKFSLYPYDLVRLVKGDEDRFLYFGTLDIDSDRLNFKDVNKPSKKNEYRYSLKTIEDLEKYEVGVLGDLRLVRKETRRNFH

SEQ ID NO: 43 - protein, 7 aa, Artificial Sequence
  source: /note="Description of Artificial Sequence: Synthetic peptide"
  source: /note="SV40 NLS"
PKKKRKV

SEQ ID NO: 44 - protein, 22 aa, Artificial Sequence
  source: /note="Description of Artificial Sequence: Synthetic peptide"
  source: /note="3X Flag tag"
DYKDHDGDYKDHDIDYKDDDDK

SEQ ID NO: 45 - protein, 16 aa, Artificial Sequence
  source: /note="Description of Artificial Sequence: Synthetic peptide"
  source: /note="peptide linker"
SGSETPGTSESATPES

SEQ ID NO: 46 - protein, 16 aa, Artificial Sequence
  source: /note="Description of Artificial Sequence: Synthetic peptide"
  source: /note="Nucleoplasmin NLS"
KRPAATKKAGQAKKKK

SEQ ID NO: 47 - DNA, 723 bp, Artificial Sequence
  source: /note="Description of Artificial Sequence: Synthetic polynucleotide"
  source: /note="GFP-stop coding sequence"
atggtgtctaagggcgaggaactgttcaccggcgtggtgcccatcctggtggaactggacggggatgtgaacggccacaagttcagcgtgtccggcgagggagagggcgacgccacatacggcaagctgaccctgaaattcatctgcaccacaggaaagctccccgtgccttgacctaccctggtcaccaccctgacgtacggcgtgcaatgtttcagccgctaccccgaccacatgaaacagcacgactttttcaaaagcgccatgcctgagggctacgtgcaagagcggaccatcttcttcaaggacgacggaaattacaagaccagagccgaggtgaagttcgagggcgacaccctggtgaatagaatcgagctgaagggcatcgacttcaaggaagatggcaacatcctgggccacaagctggaatacaactacaacagccacaacgtgtacatcatggccgacaagcagaagaacggcatcaaggtgaacttcaagatcagacacaacatcgaggacggcagcgtgcaactggccgatcattaccagcagaacacccctatcggcgatggtcctgtgctgctgcctgacaaccactacctgagcacccagagcgccctgtctaaagatcctaacgagaagcgggaccacatggtcctgctggaattcgtgaccgccgctggcataacactcggcatggacgagctgtacaagtaatga

SEQ ID NO: 48 - RNA, 141 nt, Artificial Sequence
  source: /note="Description of Artificial Sequence: Synthetic polynucleotide"
  source: /note="GFP-stop guide RNA"
ggcuccccgugccuugaccuacccuggucauaguuccaugaaagccaaaaguggcuuugauguuucuaugauaaggguuucggcccguggcgucggggaucgccugcccauuccgaugggcuucuccccauuuauuuuuuu

SEQ ID NO: 49 - protein, 9 aa, Artificial Sequence
  source: /note="Description of Artificial Sequence: Synthetic peptide"
  source: /note="meganuclease motif"
LAGLIDADG

SEQ ID NO: 50 - DNA, 318 bp, Homo sapiens
  source: /note="Homo sapiens Human RNA pol III U6 promoter"
tgtacaaaaaagcaggctttaaaggaaccaattcagtcgactggatccggtaccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacacc

SEQ ID NO: 51 - DNA, 32701 bp, Homo sapiens
  source: /note="Homo sapiens CFTR gene"
aattggaagcaaatgacatcacagcaggtcagagaaaaagggttgagcggcaggcacccagagtagtaggtctttggcattaggagcttgagcccagacggccctagcagggaccccagcgcccgagagaccatgcagaggtcgcctctggaaaaggccagcgttgtctccaaactttttttcaggtgagaaggtggccaaccgagcttcggaaagacacgtgcccacgaaagaggagggcgtgtgtatgggttgggtttggggtaaaggaataagcagtttttaaaaagatgcgctatcattcattgttttgaaagaaaatgtgggtattgtagaataaaacagaaagcattaagaagagatggaagaatgaactgaagctgattgaatagagagccacatctacttgcaactgaaaagttagaatctcaagactcaagtacgctactatgcacttgttttatttcatttttctaagaaactaaaaatacttgttaataagtacctaagtatggtttattggttttcccccttcatgccttggacacttgattgtcttcttggcacatacaggtgccatgcctgcatatagtaagtgctcagaaaacatttcttgactgaattcagccaacaaaaattttggggtaggtagaaaatatatgcttaaagtatttattgttatgagactggatatatctagtatttgtcacaggtaaatgattcttcaaaaattgaaagcaaatttgttgaaatatttattttgaaaaaagttacttcacaagctataaattttaaaagccataggaatagataccgaagttatatccaactgacatttaataaattgtattcatagcctaatgtgatgagccacagaagcttgcaaactttaatgagattttttaaaatagcatctaagttcggaatcttaggcaaagtgttgttagatgtagcacttcatatttgaagtgttctttggatattgcatctactttgttcctgttattatactggtgtgaatgaatgaataggtactgctctctcttgggacattacttgacacataattacccaatgaataagcatactgaggtatcaaaaaagtcaaatatgttataaatagctcatatatgtgtgtaggggggaaggaatttagctttcacatctctcttatgtttagttctctgcatgtgcagttaatcctggaactccggtgctaaggagagactgttggcccttgaaggagagctcctccctgtggatgagagagaaggactttactctttggaattatctttttgtgttgatgttatccaccttttgttactccacctataaaatcggcttatctattgatctgttttcctagtccttataaagtcaaaatgttaattggcataaattatagactttttttagcagagaactttgaggaacctaaatgccaaccagtctaaaaatgcagttttcagaagaatgaatatttcatggatagttctaaatactaatgaactttaaaatagcttactattgatctgtcaaagtgggtttttatataattttctttttacaaatcacctgacacatttaatataggttaaaaaatgctatcaggctggtttgcaaagaaaatgtattacaaaggctgctaagtgtgttaagagcatactcatttctgttctccaaaatatttcataaggtgctttaagaataggtatgtttttaaaagttaagttcctactatttataggaactgacaatcacctaaaataccaatgattacaaacttccttctggccttctggactgcaattctaaaagtgtaaaaaacatattttctgcattaagttaggcagtattgcttagttttcaaagtggtaggctttggagtcagattattttgattcagatcctacatctactgtttagtagctctgttgcctgaggcaggtcccttaacatctctgtgtgtgacttgacctttaaaatttggagactgtcataggggttaatcccttgagaaaatgaatgtgaaaagttagcctaatgttaactgctattattatggattaccatattttcacattcatcacagtacatgcaccttgttaatataagatgctcaattcatctttgagtataattttgtgactctcaatctggatatgcaatgagtgggcctgtatgagaatttaatttatgaaaaattgtgtttcacatggccttaccagatatacaggaaacacgtcacatgtttctattgtatgttgttaaatgccttagaatttaactttctgaataggatcccttcagtttgagagtcataaaagagtaaaattattatggtatgagttatagattgtattgaatatctctttatatgtctaggttttgtcattggaaaaccaaaaagtttggaaaaaaaatctaagttatttcttactttcttaattttgtgtggatttcacatcaagtataaaatttgaagaacatctgaactatcataatccatatatatatataaaataaacataatctaagagagaatttcaccatgaaaaattcaggtagttcatgactatcagagcaaacaagtacattaaattgaaacttttatgaaaataacatttatgaaataggaagctatttttaaactagaagtgatatattagcatataatttataattcatatacaagtgggattgatttataaatggtcaccaacagagattgtgctatttaatttgggaaaattttttaaatttacattttctcacaacttttaaggtagttattcagtttgttcctctctgtctcttctctcatgccctgaatttttcatatttcgtttagttgtaagagtgtatatcaaaccgtgtgtcacatgacataacttgaattttcgtcgtgatatctgtgctatgtctaggtctatactgaggaactgtgggaaccccacagaatccaagtatacagtgccactgatttcttacaagggatgtggggtctcctgtaaactctgcagttagtctcaagtaagaccaaagagtaaaatattgttaggatctaaggtggaaattcagcaaagaatcacatagtctaagtctcgagtttaacagtaagataatttgagatacttttgtaattattaaacacaaagtaatgagagattttaaaacaaacaaatacacctgaatttatatatcagaataggtatggtggttcaaaatagctatctaataaaaaccacactcctattctaaacatttgcctttgatcaaaataattttgggtctcttattatgaaattgcctttctaaataatacataaatttcttctcataagtatatattagccacattattttattgttattgttttatattcatagcttgctttagattaaaaattatattacccagactggtctcttggacttgcttccaagtgacttttgactgtatcacaaaatcaaattcactctgaaaatataaagatttttcatcataatttcctttgttaacagccaagtgctacctaattttaggtgttttcattaaaaaaaaatgcattgcaaactttaaagacaattcttttgtttgtttgtttttaaaagacagagtctcactctgttgcccaggctagagtgcagtgacacaatcataactcactgcaacctccacctcctgggctcaagtgagccttccatcttgcctcacgagtagctgggtcttcaggtgtacaggtgtgtaccaccatgcctggctaactttttttttttttaagttatatagagacagtatctcactatgttgcccaggctgctcttggagctcctggcctcaagttatcctcccactcagtctcccaaagtgctgggattacaggcgtaagccacctcaccctgtcagcctaaagacagtgcttaatgaagagaaatataagtgctttgagcaatggaagtataattaaaattatactatgaaagatttataaagatgaccattttgaatgggaccacacttatttggttatataaattatgatacactattaaaaattcatcatgatgattttgtatttacattttatttacatgtttgcaatttgtgaggaaagctaaaattatggctaagccataaatatttttgcagtttgttgagggtgtttgtaaaagtgttgccaaggaagaccagttggctacccaaacaagggtttagtctaggtctgatcaatacatacacattatctcaggtttgtctatcagaaaaaccttaggttatccaaatcaaaataaaatagatgcataaaacaaaggccaatatgtgttgaacaattatattgtgatatacaactgccaagcattcccgattaccatgactccatttagtcagtccatgggcaaatgccatcaatgaggacagcccagggtttccatattctctcttggctttacatcctataggaattggaggggcccacctctgggataggagcccttctgtcttgaacaatgttgtctgaacactaacaaatgttgactttctacaccagtccctcaatagtcttttctatttatccttttgctgaccatgttttgttattacacagttgagatttttcagctgggaatctgtgttaattttgtattaattttgattagcttaactctcagagttctaaaagtacctcctgtacctgatatatgacaaaaattataattacatttatttatatataaaatatctttgtatatgtaaaatatctttgtatatataattatataattgtttcttttaattttgcaaattttaaaaagttctcctttgttttgaagtttattcctatagttttttatatgctagttaaattattaatcacttgattcaagtaatattcttatatacttataaggaatagtgtagttttaatatttaattccttgctaaagagagaagtggaatctatttttcttagctacttcatcaatattttatgtttgatgtgacagtcaaaatatccctcagagctaactgttacactagggaaatcacggttttccagttttccatttatgtgttatgggagggagtggaacttagtgtaataatattcaatacataaatgttaacacttgtttaaaggtccttgagtgagtactgctataaaatgcattattattgctagtgtcatttcacaagagcctataatttcagtgtgatagagctacaatataagtatagtattgcaaaaccatcaggaagggtgttaactatttagcatgcagttatgtgttggttgtcaaaacgttaaaaacatctctgactcagcagcaattttggcaattttgatcctgaggcatctgtgtagggcatcttcctggagaaaaacctctgagatgcaatgaggtcaaaaggggaaaacagactatgataaagatcaagttgtttggagatcttgtagaaagattaatttacaaatatgtcaagtgcattatcatggaggaaaacattgctatttctgttggttctcttcagagctctagaatcaatttaccacatagttgtttcagtgtgaaattagcattacagagtggctttacggctttactgtagggcattgtgtcagcaaagagcttaggcttcttttagcaagaagcttgtaaaaatttaatttactcttagattgcttgatgtagagaattacattcctacagagctctgaaaaatcttttttcagagtttttcacagctgtattcaagttgcaaggcttgtcaactttgctatttttctgtgcagctctgttaacttattattatcttttgacataaattatgattccaaattgtaaagctctggatgtcagggccttttctaatttgtttagtatgatattcagaccatttcaagactcttccgtggaacaatttaataaagatttttttgtgatgttaatgagttcatggtgatcaaccctagagacctgtgtctattgtagatcgatgacattcaacagtcctgcagtgctggcatcattttgataaaaaggggtcaaagcaagtgggactgtgggcagatttttaatgcttagaacaattattccatcgaagttttcttgtgtcccttctgccttagcctttgtaggatagcatgcttgctaatttcttgctcatggggtaaggaaatgaagatttttgctaggtccgtaggattattaggactactcaggcctgaagctatgcctggatatagccagaaaactctcccatagcttgctccaaggagctgagatacagcagtacttcctttgtaggtcatgattctgggtaacctggaagatgacctcattcatattctgtattctatgtgagacgttaagaaggtagaggtggccaagaaggaaattgttgctgcctttatggaacaaattatctgaaacccagctttctcgagggcttcattgaagtactcaactggggcacttaacccagtctaaggctggtcaaggaaggcttgctgggggaagtgtcttttgtattcacacctaaaggaggttattcaattagaattatccaaagagggtagggatgggctaggaaaaatttaaacaggtagtgtggaggactgacaggataagtaagcatggcaccttcaaaatatcctgagaagttccctatgacgggaacataaaatatgtgacagagatttgtgggagatgggtctggaaactctagcaggggccagatcgtaagggggctttgtaggctttgtaggctttgtttgggctttatcatactggaagtgaaaagccatggcttttaaacaggagagggacataatcagttcatatactgttgcagttttgtaaaagaaaagatgagctgaaagagtggccatggtggaggtgggtggggtgggggggagggggcggggagagagagagagagagagagatttgaaagacatttaggaggtaaaatcaactggtttggtaatcaattagtagttgaaggtgaaggaaagagaagagttaaggataacatctatatttgttgatttggataatagaggggacagtggtgctgcttattgaatgagaaaatttaatcggagaagaaggcatggagcaggagtgcagacctatgtgactctacttctctcaaaaccagaaacggaaatgatgtatatggctcagggttaggtaatatggttatttgaaaatgtattaaagtgatttagagcttagtcttaggtaagagatataagatgtctgaggtgacagttttataaatatgtagagtgcccacttgtttggccttattgtggcatagtgtgacctgagagtgttaggaagaagcagctgagttctagggacagtactggttaaattctacttagaaattatacttagaactctcctatataacctgctaactgatgtctgaacctcctgataacttcactcctttaggcagtgcttttcacatcacgggacacaacatatgagagatcatagaaattcaatgtggtatgaaaatctgcttgggacttcagatattgtctccagtgattgaataaaaataggagctcacctactatgatgaggtttctgtgtgtgttaaaagaaggttttcattacttttgaaaaggttatgtatccttgttttatgttaaaactttgagctttgttaaatatgcagagttctctttcttagcatggactacagaggtgcaactacctcctacctgacttcacatctactcccaaatgcctagtgaaggcttaataatttcaaaaagggactctagaatttcatttgataccagtcagacaaatgtgtgaaaattaagcataataggcagaatcccaggggtactgacagctgtattaagaggtgattcaagggctaaaccttagagtccagcattggttatgggtgtgacaagaaaatgaagcctatgttggctgggattagcaaccacagttctagaggaagcaaggtggagaaactatatagggggctccctttgtacgttttatttattttaaacatctctataaactctagaaattaaaacaacaataccaacacaaaagcatcactttttcgaccaaagaccattgctatacttttttgtgtaaagggctagatagtaaatattttcagctttgtgggccacataagtctctgcaatagacaatatgcaaacaaataagcatggctgtgtttcaattaaactttattatgaacattaaaatttgaatttcatataacttttacatgttgcaaaatattctttatttaaattctattgcaatatgctttaaaagatacagtttttagtctttcttagtttaaaataaaatctagaaaaaattttaagtcttctataactttttttcggtaactgaataattttaaaagtaagtgaaacatttagacatgcaaaatggacttttcagaagaagaaaatggtagcttaacagttattagattattgtccagaataatttttgacttataagtctctgttgaccatttcattgcctctttttttggaatatgcatcttttaatgtgtccttcaaggcaaaggctctatcttatctatcttgtgtcttgcattttcccagggcaatgtttttcacaatttttttaaaaaacaatactgtaatcaattttcaaataaaattttccatgggaccgcagtgtatacaaatagcagtgacaataaaagataataactctcccataaatacaaagaaacagttaacctagtgctctaaagtaaaggctacagtgattttgtataacatttatatgtaattttcttgatcctacatggttgtgtttttcacagtgttatgtttctgaaatcgagatgccttttataattgatgtcaaaagaaacttgtcagccacaaggcccaggaataagttgtaatatgggaacttagcaatacataaaggtatatatactcctgtgacctcagctgaattatttgcattggttgcatcccacaaggttgactcttaaataaatttagtttgttgcttgaaatttcttgggataaattactttgtgatgtagttttgaaaaaaaaacaggtaatatttagtctgaagtttgtctgacatactaagcaatgtaattaaagtagaagtcgcctaagctcagcactttattatgccttgaaattatactgcctgtcctacaggtgaaggtgttatgaatgcagtttgtcactgtaactctattcatagctctgaaaggctgagagtgactcagaagaatatttttgctctgaatatgaagaacgcttagactaaaactttaattacgatgctgaagaagaaagtggtaggtgattgcatgaataagtatgtaatattgttaatttctaaaaactgtgtatagttaatgtagtgcttctttttggaaaggctattgttaaattgatggtaaattctataaccaatatcaccttaaagcaagtacgcatgataaagtattataaaaccatgataatatcatatgtggcttattattgttccctgagtgttgtacaactctgttatgctgtgatgaaacctcatgcaaacaggtatgtcaaagatatgatgggctgttaactgagcttggcccacatatggtgtagtgacatgctcactaatgcagtgcagagataaccaataacagatcataacaggtttaaatatgtgcaaggagatgtcagcagaagctttcctacatagtgaatactaaacaagcctgacagcccaggatcatgttcggatcaatctagtgtgctaaaattaacatatagtcctacatttgagaatgtgtgattttcttggttcctgtctataaaataatattttaaaatacatacatttcaaatcagaagttggtgaattcactgaaatatttctagagaacactaggtattggggctcatagtgtgaaaaccactgacttaattcttcccccatcttggttgttcctgatcttcccttgtgtccccattccagccatttgtatccttagaaaatgatctcatattctacttcatctttatcttcattgtcaactgtcaggtagcaatatatgatggaagaagcatgtactttggaatcagacagacctggctggaatcctaactctgtcacttattaacaatgtgatcttaggcaatttacttaatctctctgaacctcagctactctcgtcagtacaatgagttatccttatctttacatggcacagtattattatgatatcaaaaattcattgagtatttactctgcatattagtcaaggttctccagagaagtagaaccaatgatacacacacacacacacacacacacacacacacacacacacacaatttattataaggaattgacttacatgattatgatggctaacaagtccaaaatctgcagtatgggtcagctggcaggaaacccaggagagtcaatgttccagtttgagtctgaaggcagtctgttggggaatttcgtccttctctgggaggccagcctttttgttctatacaggccttcaaccgattggatgaagttcacctttattagtgagggcaatctgctttaaccaaagtttactgatttaaatgttaatctcatccaaaaacacccacccagttgacacataaaattaaccatcactctctgtaagcactttctatgcattaagtgatagcaaataatgccagacatagggcgtctttaataaatggtaagcactgttatcagcaacaacaggattattataattagcaccttttcatctttctgtctgggctctgagaaagtacctctcttctctaaatttatccctcctttcctatgaattagacccagtgctttctctgaattatgaaggtcacactcctacaaatgccccttcccaattgcacatctgtcggctttctttgccattgacttttatctctagcttttaaatttacaggcatatgtcagttaacaatgggaatgcgttctgggtaatatgtccttaggcaattttatcgttgtgagaatactatagagtatacctacacaagcctagatgtcgtatagcctactacacacctaggcaatatgacatagtcttttgcttctaggctacaaacctgtacggcttgttactatactgaatactgcaggcagttgtgacacagtggtatttgcatatcggaacatgtctaaacacagaaaaggtgcactaaaaatactatgtagtgatctcatgggaccaccattgtatatgcagtctgctgtagactgaaatgtcatgcagtgcataactgtatcttaaatactcaaagtatcacctttgtttgtttgtccccttgtgtgcatcatcctaacgtggaatttctctgttgattagggccagcgtattagtttgctagggctaccataacaaaataccacaaatttggtggcttaaataacaggaatttattatcttatggttttgaagactagaagtacaagatcaaggtgttggcaggtttttcttctaagggccatgaggaagagtctattccatgcctttcccctaccttctggtggtttgctagaaatccttggcattccttgacttacagaggcatcaccctgatctctgttttcatcttcacatggcattctccctgtgagcctgtctctgtgtccaaacttctttactattaatataaggacaccagtcatattggattagggtctactttagtgacctcattggaatgttattacctctgtaaagatcctatctctaaataaggtcacatccttaggtaccgggggttaggactcaaacatacctttttttggggaaacacaattcaacctataacaattgataacactctttaggagcagaatgcgatatggaagtaatttgagaccataaagtatatacatgtagggagttaatctatgaaacctattgaaagccatatatacctcatgtatagtggtccataaatagcatggagacattgcagaggatgttaagtgatatgatacaggaacaatccaagaaggtcataagaaaaaggaccttttgctcttgagaggactgaagaatgactttccatttatgaaattttggtacatgtccactaaaaataggatgaaggccaaacttaggaagaatattttgataatggagaaggttgcatataaaaacattttattgaggacaattaaataatgttggctggaagttttaggatgatcatctttaggactcagaaaaagagaagaaacattattaaagaattgtccctgaacaagtataggcaccctcacatttgcattgcatttactatagaattgaaaaatgttttgaccttttttttttggcttttaatatatttgaccaagagtaacagctaagcaatacctatttgcaatcagtgtcatcatgtgggctccaaacatatcatgtttgtgtaattaattgattgacccattaatttgttcaatttctgctctgttccaggcactgaacaacatgatggagataaaagataaatattacacctgccttgtcctcaagaagttagtcttctgagggaaagaaattagcaaacaaattgtaatctcagttatgtgccatgttccatgctgggcacaggggatacagtagtttaaaaaaaacacaagatctataaggtgtttcttcttgtggaccttacagtctagggtgcttggaaacatggggcgttggcagacaagtaaatacacattttgtggtaaaggctcaggtagaagaagtacaggatagaatagagcacaccatggggaattaatctagacttcagagaggctcacacatacataatttatgtgtgactatttcaatgcatttgaggtttcttggaaatagaggttaggttttattttaaggaagttaccattttttttttcagtgtgatgtggttgaaccaaagaatgccatgcccagtgatggtaataggataatctttttaaaaattaagagccacctaataaatcaatagtttcattcagcgggagctcctgcagagttcaaaaagaagagaatctggcacagcgtttcctttaaagttcattttcctagagtgtgaatggaagcaagagattataacattttgaggtcaaaaaaattctgaaatgcctataaaaattattttctccaaattatcatcatttgtgcttttaatgacctgattgcaaagatgaacattttgaattcttaaattgcttattaggattggttaatgaatcaattatctattactgtatgttttgctattggaaaaaatagcaacttaagtgttttgcagacctttacttaggtatatgttgcttttatgaaaaaaaagatgtaaatattaagtaaaagggatttaaagcaaggcttttgaggtagagtcttattaattccttggtaaaccttgagccaattgttgtctatgttctctgcctctgtcttgctccttccttctgggattcactgtgggaatgcgggattgttaatctggggatgctgtccaatcctgcctctctcaagctttgctattgatctccctcccagtgataataaagcttgaagaaaatgaaagtagcgttagtattggtcctcaaactcaagaacaggatgaaacttaaatcttgagtcatacaattgtgtctacatactgctccccaaaaagagaagtaaagaagatgctaactttcccttttaatttgcagtacttagcaatttgttttcttgagggttaagtaataacagtggaagaaaaaagggttaaaatgccaccaagaacccaattccatgtttagtttgaaagtgggaaatcagctgccactgggaagtctgaatccaatgccatgatgttctttgaatccttctgagaaataatcatgtgtagccataacatacctgtataacagagcagagaacataaacaaatgaaggtgaagggaagattaagacagaagagaaaaattccagaatcgactgatcatttttatctgtttagatgatttcaggcagaatcctagagaccaactttatcacaactgaattttaaaaatcaccagctttgtcattgtgatgcagcatcagtttcagtattatccttggagtattaattcttaatcatcttcatcttagaacatttttgaggtcacttctagtctctatttcaccagtgaagaaacaaaaatccccaaactatatcaggtggaattacacagtattttttttttaattttggggaaagtcgattcaaggcagtaacttgcaagctagtgttagaaaggatttaataaatagtggtttttctgtacacatagtgagaggtcattacatcatttggttgttgaaagtcataaggatgtctagcatgcgctttgcctgtagtggttcatgccaggcagattcctgactcctataacccagagcttatcagagcatttatgtccccaaagagaaatgtcacctccatctttcaataaacactttagcaaagaaaaatcaagtactttaattccaaatcttgagttaattccagaataacaatgatggctcggaaaaatatgggtatttctgtcaaaggacagagaaacctagtagagagtatttactttgggtcctagtgatggtatctgaacaagctaggtgaacaaagagcctcaataagggattttgaggtctagaaaaagagaggaaataccaaataaatggaataattataaaataaataccagcaaagttaaatcaatatatcatgtgggagatatccttatatcactcatgtgatttctattttgttcctatattaggccaaggagaggtggaacttgttttcctttttccctctcagctacgaatggacatacttaaaactgtttctctgcttctgttctctaaaatgtgattgtctaacagtaaccgtgatgacgttttgacagttgcacaagtttctttctttaagctttaaaaatgccagccagtaacccagtggcatttctactataaaatcttaaggccaatccatttccccttttccttattttcttggtttcaaatatatttttattgccaatggaaataaaaatcctaaattagagagcaatggcatcccttgtcttgtgaataaagagctcctaaatgtgaacttatacaggatgcagcaatttatagggtagttaatcattcttctttctagccagttgttccagctacagttttgtggctcttgttagtggcttcattcccagatagaataaaaatcaaaccaaaatcctggaaaggcactctgaggatgcttctctaaagtagatgggcatcaactataaatcacaatgctttgtttcctctgttatgtttcaagatgggtgggattttttttgtagcattacttattattgcctctcaagtgcttgagtctttgaaatccaagtcatgtgagtgaattagatacagctgttagaagtggcctttcaatgccaatggtacacattccttggtttctttacgatactattgctcttacaacttttatctgaagtcataaattcatagttgtcccagaagttaagttccttgcttctagaggacagaaaacaaacaatttacacaactcatggtgcatgtcaccagtccttagatctcatgaaatatgcatgaaatcttaaatcacttgctgtagccacccagccattgacatatttgaaagactttagtgtatcaaagtcactataatgaaaattttgatttcaccagttctaggagtgaaaaatcaaatgtttagtaaaactttctaaaattaacactgacagttgatttctgtatactgttgttcttaataatagctttattgagatataattcatattcaaaacaacttacccatttaaagcatacaatccaatgattttttagtatcttcaaagagttgcctatcaccataaccaattttagaacactttcatcactgtaaaaagaaactccattcctattagcagtcattccttattccaaatccccctgctcgccctagacaactacaaatgtactttccatctctatagatttgcctgttctggaaattttatgtaaatagaacaaagtgttcttttgtgactggcttatttcacttagcattttttttcaaagattcatccctgttgtagcgtgtatcagtgcatcattcttttttatttttttagagacagggccttgctctgttgcccaggttggaatgtgcagtggcatgatcatgggtcactatagctttgaagtcataggcgaaagcggtcctcccacctcagtctcccgagtagctgagactacaggcttgcaccacatgactgtctaatttataattttctttagagacagggtcttgttatgttgtctaggctgctctcaaactccagggctcaagtggtcctcctcccacagcatcctaaagtgctgggattataggtgtgagccacagcacctggcttgcatcattctttttattgttgaataatatcccacttgtaagaatatgtattttatttatcctttccccagttaatagatatttcgattgttcctaattcttgtctattataaataatggtgctatgaacatttgtgtacaagtttttgtgcagacatccattttcctttcttttgggcatatacctacgagtgtaatggatgggccatatagtaactttatgtttaatattttgaggatttttcaaactgttttccaaagtggctgcatcattttaaattccttccaccattgtgtgagtgtttcaatttctccacatatttgcaacacttactattatctactcttaaaaattacagccatcctactgggcatgaagtggtatttcattgtgagttttttttttctttttctttttttctttttttgctaatgtttgtggattttcttttcattttcttgatggtgtcctttgaagcacaaaagtatttaattttgataatttccaatttattttttgttattgctgtttgtgcttctggtgttgtatctaagtgtatgctactttaaaaaattagttgtaatatggcaaattggatacatgtgtaggctttggtgtcacaatcctaattttaaaattctgactctgcccttgacaaattaactaattaagcttccttagcctcagtttctcaactgtaagttggagatattaccaagacctacctcttgaattgttgtggggatcagatgaaataatgtatgtgaaatatttagaattatgcaagtctgtggtaatgaatactaatgttagctatcattattgttataatcccaataataaattctggtgctttgaaaattaaaccaaagccaagcagttgatatgaagaagcatgtaataatgtacagacataatgctttatagacaacattgaatttggctctcatgaacatcaggaatagtggtcatggtagttattatctccagcaggaactgtagctgagagatcttcagagctttttccaaggcgatatcactgggaaataatagagacaaggttacaagctagggctgtgttttcttcttaaaatctttagttcagtttttttcaataacagatttgtagtaggcatcaggtgactggggattcgtattcttcaagttgaaatattaccttgttgagaaagaaaccatgtgtgagacaaccatgttgagaaagaaaaagtgattttatagaaaattaatattgatagtgagcattatatgaaaatcatgaagttagaacatatttggccagaaaatttacattaatagttacccatagcaattaatgcattataattacacataccttttctttaatgaaaaagaattctttccttccaaagttatgcatgctattgttaaacattagagaatatagagaagcaaaaaagaaaatatcttttttgatattttcttaacatacgtctgttcctaataatgtttatagtttagaagcattgcatgaaatgggtagatcaattttctatttaatgtttggattcattaggtacgaagttagcaaattaatttccattagggtgcctgtatggttgtaaatcctggacctgcagaagatttttcagtattggtttgtagtcttttgtttagcagcaaataattagttctccagagcttctgaaattaattgaccactttaatggtgtttacctacctagagaaagaaaaagaacttctccaagtcccttggtaaaattaagcctcatgaacaattaactcaaatatacacaaggcttgtctttagcgagcatatactccctaaagttgattaagctgaccaagtgattactgcttataaattcaccattttatggagaagaagcaaacactgctaaataccttgtggaatcagaggaggggaaattagtaacttgaccccaatactgcgattttaaattgaattcttgaagcctacaagttttacacaggactttagagagctggatagtatcactttgtcaagtcctacttttactatgattctttgagaaaaatacatctgactaaataactctgaatctaaattggataaaataaatgtgacattcaaaatgttatttatgattttagaaaaatatccttatagacactagatgagttttagtctcaaatcaatcctccctatcatagtcacttatcaaaataactaaagcaaagtggtagagctgtgctctagaagtttgggatttatgatcacaatcttttccaatgagtcccctctttcctctgcctgtcttcaacatttgtttttttttttttttggttaggactatccagattgtgtggcctatttcaaactcatggcaaatacattggatgatcagaaattttctaatgtatttgaatttgtctacacaaactagagtaattgctattaattcctcaagtgttaattatttcatgcaaaaaggaaaaaggctattagtctttaagtgtattagtatgtcaatatttgggagaagtgtcatgcaattagtggtttgaatttcctattttattttattgcattttattttatttgcctagtcaaataaaaagtaatgttaaatacatggaagcatgattgttttctacactaaaaatcattttgacttgaaaagatctgatatccatgaccttcatctgaagttttggcagatgaaaatgtcagatgcgtcttttggattaataaaaggcaaaagtcagatcgaaaaatgagtataagctttaattatatgactttaggaggatatgttatgaaaatcaaagctttaatagtgattataattggcaagttctttttttataaggaattacaagtcactctatacaaaaattggaatttttgtcctaagaaatgaaatttactatagtttcatctgtgtgtgtgtgtgtgtgtgtgtgtgtgtgtgtttaaaaaatcaagtgatagggcttttcctcaataaaatctgaaatctcttatagttaagtgaacagaacagtgtatctaggatgctagacttttttttcaaagttagtttaaaacttatacatagtaaaatctgtatgccttagggatctctgtttgctatcccatagtgaatgattaattagtttctgttagaaatagtcagaactaggctgggtgtggtggtggctcatgcctgtaattccaggactttgggaggccaaggcaggaggatctcttaagcccaggaatttgcaaccagcttgggcaggctggtgagatcctatctctacaaaaacaaacaaacaaacaaaggacaataagaaagaaagaaatagccagagctttgaacaaaatttctaagtagaccaatgtaaaagtctgtcgtcaatatgtagtggctatgaatggaggttatgaatgaaagagaaggataagatgaactagaggtgagaggggaagacagcaggcccaagtgaaaggcagagccgagtttattgctttttggttattccaggtgtgtctgctttgtctcatgaaacacctggatgatcactgatttctagtggaagaaatgctgaaaagtccttactgtgcatttaaacattctaggtttaatatactcagggtttttcaaaagaaagggtggctggagttttgcactaactaatatttcataaagtgtctaagtatagatgtctggtttttttttgtatttctaagactggcttgaggtaggcatggagaattctttgatgggacataattttcttcctttctttttttttttttttttttttttttgagacggagttttgctcttgttgcccaggctggagtgcaatggcacaatctcggctcactgcaacctccgcctcccaggttcaagcaattctcccacctcagcctcccgcgtagctgggattacaggcatgtgcccccatgcctggctaattttttttgtatttttagtagagatggggtttctccatgttggtcaggctggtctcgaactccttacctcaggtgatccacccacctcggcctcccaaagtgctgggattacaggcgtgagccaccgcgcctggcctgatgggacatatttttcattcaattttattgatttaacctcacaaaataaaatatttccttaagatgactctgtggtcattgttgggcagcataagcttaatggattttagttatcataatttaccttaaacccaatttgtatttcaggatataaatagaggtttattgtagtgaatcttccaggaaatactaagtgatactaataattatagatggtgaacttaagtctttatattactgaatttgtttggtttgatgatgctaggctatggcattcttgctaatcaaaacgatgtgtcatggtgtaacataacttattaaaatgggcacagataacacaggaagctttttataaaagcagctcacaaattgtgttactttgaactgaactggccatttatgggaaaggtcactgggttgtaaataaggaccaaaagagttacgtttatattttttaaaagagattgaggagatttatttttacatttcttgaaaatgccttattttggtatggtattgacagatagtgaaattctgctcatttgtaaatatagtgtcatattttaataatttcaaacatattgaaaatgcagaatttattaatagtgggagcacattttcctttttactaaatgttctacaggttcttttctttccatccacacacagtgccattaccctcattctaagcctttcaaacatctggcagtaagtgatctgctgcacttagctctttccagctgagctgatttttaaattttcagaaaatttgtgagctaattgttaaacatggccattattaaaaattaaattatttcaacttataattaaataaattatattaaaacaaaagtattaaaaactcaaaagttggctgggcgcactggctcacgtctgtaatcccagcactttgggagaccgaggcaggtggattgcctgaagtcaggggttcgagaccaacctgaccaacatggagaaaccctgtctctactaaaaatataaaaaaatagccgggcatggtggtgcatgcctgtaatcccagctactcaggaggctgaggcaggagaattgcttgaacccaggaggtggaggttgtggtgagctgagattgcgccattgcgctccagcctgggcaacaagagtgaaactctgtctcaaaaaaaaaaaaaaaaaaaaaaaagaaacaaaaaaaaaaaaaaaacaaaaagcaaacaaacaaaaaaacaaaaattatcacttcctaattattttgcattttactattatctatgctattaacgttatttgccttcattgtatttgaaaggtggactatattctattgcactttcattgtactatattctaatatgcaactgtgtatcccttcccaactctgtgttcaatgactttatatttggttgctttaaaatgatgacgatgagagtatttatatcatagaaattggcaaatgccgtaagtcagtttttgtttttgtttttgttttccggagaggggattgttaaatatttgcctgcatgcaacaccactacatgcagtctgctatcttttgttcttcctgctttcaggctcctctcccagctgtctgtctagcacaacccagcataccaaattttcttaaatagggaaagttgaacatggtaaaagaatgaatgaagtcaaaagaatgtggaaagacctaggctttgccatttagtaaagtttagcatctctaagcctccatctctttatcaataaaattgagcaatgatcccttttagttctacccatttaagaagattttcaaatgaaaaccacaacctgctcatgtttatgaaggcactttggaaagcgctaaatacacgggtttttattagtagtaaacacttacttcacctttttcacttcttgactttagtttacaagggctcataatctaaattatatcataaattgctgtcccagatttttttacagcctaattgccacctgtatgttcgactttccttctgttctttatgttagatactgggatagtatgcaccaggtgggtgtgccatcactttctcagatgatgtccactgaagaccttgcatgatcatggcattcattttcctgctgtattcagactggcctcaactattttctttattgctctccaggaaaaattacaaatgaatcagactgggcaatgaagggtaaacctaattatcgctctttgttaaagacagctcttgttaaaatgcggatattgcaaattaatggaaaaaatatgacatagtaaaccatactcacttattaatatcttagtaaggaataattgatgaagttacttaaccttagagccctaattcagttaagttttaatgaaggacaagttgtagagatatcgagaacccagggcaggtgcctactgaagaagttccagaccaaggaagtataaagaaggacctgggtgggagcagtgagattggatatgagggccactggcaaagttttgccccagaacagtgtcaaaatgtttgcatttggcatagccctttctctttttgttctgaatggctttgctagaatatcttttctataatgaatttatcctgcttctcagatattgctaaagcactcccttttgaattttggtgctttaacatgcattttgatacattaccaaataaggtctgaatgacacaaattttagaactctccagagaaaagaaagatgctgagggaaaaagcataggtttgggactcactaaatcccagttcaattcctttctttaataaatatattcaattttacctgagaaagctctcgtgctctcgaattttatttagaaatttctctttgtacatgattgatttcacaatccttcttctgcctcctcttctactttcttctttctagattttcctatctttatgaagattattctgccttatcctcaacagttagaaacaatatttttgaaaatcactacggtatcctgcatagtgatttcccatgccaactttactaatttccattataaattattatttattgatgcctagagggcagatgagtgtagctgctatggagtgaggagacaaaacataagaaagttatgatcctaccctcaggtaatgattcagacatgataattaagtcaacaaattgatagaaactaatcactaactctctggctatagtcattctttcaatgaatagctcattactgagtatgcatgctacagtaacaaaattatataaggctgttgattaaatgttgattaagtgcatgtcttattcagagtttttttatatttgaaatggaagaggctggacttcagtaatttgctataaactgctagtatatgattatttgggggcagttattttttaaagaataatttaaatatggaatgtttagcagtttgttttttccctgggaaaaaccatactattattccctcccaatccctttgacaaagtgacagtcacattagttcagagatattgatgttttatacaggtgtagcctgtaagagatgaagcctggtatttatagaaattgacttattttattctcatatttacatgtgcataattttccatatgccagaaaagttgaatagtatcagattccaaatctgtatggagaccaaatcaagtgaatatctgttcctcctctctttattttagctggaccagaccaattttgaggaaaggatacagacagcgcctggaattgtcagacatataccaaatcccttctgttgattctgctgacaatctatctgaaaaattggaaaggtatgttcatgtacattgtttagttgaagagagaaattcatattattaattatttagagaagagaaagcaaacatattataagtttaattcttatatttaaaaataggagccaagtatggtggctaatgcctgtaatcccaactatttgggaggccaagatgagaggattgcttgagaccaggagtttgataccagcctgggcaacatagcaagatgttatctctacacaaaataaaaaagttagctgggaatggtagtgcatgcttgtattcccagctactcaggaggctgaagcaggagggttacttgagcccaggagtttgaggttgcagtgagctatgattgtgccactgcactccagcttgggtgacacagcaaaaccctctctctctaaaaaaaaaaaaaaaaaggaacatctcattttcacactgaaatgttgactgaaatcattaaacaataaaatcataaaagaaaaataatcagtttcctaagaaatgattttttttcctgaaaaatacacatttggtttcagagaatttgtcttattagagaccatgagatggattttgtgaaaactaaagtaacaccattatgaagtaaatcgtgtatatttgctttcaaaacctttatatttgaatacaaatgtactccctgggaagtcttaaggtaatggctactggttatcaaacaaatgtaaaaattgtatatttttgagtacctgttacatgccaggtagaatatctcctctcagccactctgagtggaaagcatcattatctctattttacagaaaagcaaactgaggctcagagagataatatactttgccagttaatgaatgatggagccatgattccagctgaggtctgtattgccttgctctctaggaatggtagtcccccccataaagaatctctcagtttcctttccaatcaaaaggttaggatccttttgattgccagtgacagaaacccaatttactagcttaagtaaataaaaggaacgaatttattggctcatgaagcctgaactatgtgaagacctaggtggagaactggccttaggaactcaatgggaccaaggactcaaatgccacctggtggcatttgccttatgctggttttattttctcagaccggaccagctttctacataaagtgggtccctggttagaactctttgctcctatctttaaggaccacgaaagaaggagccctttgtccttggctaaatgtgaaaaatcccagagactcttgagtcatagtgcttaccccttgggccactcatagtctagaatgaactaggctgagtctcgtgccaacagcacaggcctgatgccagataaaagggtgagtgaagggggataaaaaataagacatagctactaaattattgcaccaaagtaaaaacattgagttgacttgcaatttgtttcttttaattaaattcatttcctttttttggcattttgaaggcaaagtaagatattaaactttatttttattgattttattcaaagaattaagctagtgggagtagcagattcacacttctaagatcaagggccagcttctattattgaacacttggtgtgtgcaaatgccatgaggtagggatactttgttttgttttttattttttattgggttcgatctcttttgtttatgatgtatccccaagtgcctagaatagggcctggcatatggtatatactcaataaatatttgttgaatgaatccatgatggaatgtgaaatggctagcattacatagaaacctgtagcattgctggagagataaaatatataaacataatccattgcaggtatattgacaagttcaaaataatataatgggtattgaatatctaaatgtttgttgttgttgttgctgttgtttttgagacagagtcttgctctgttgcccaggctggagtgtaatggtgcaattttggctcactgcaaacttcgtctcctgggttcaagtgattctcctgcctcagcctctcgagtagctgggtttacaggcactcgccacaatgcctggctaatttttgtattttagtagatgtggagtttcgccatgttggccaggctggtcttgaactcctgacctcaagtgatctgcccaccttggcctcccaaaatgctgggattataggtgtgagccactatgcccagctttgaatatctaagttttaattggatgctgagggaatgattaatcagagtagggctgggttaattgaaaaatgtgatacatttgtatttatggccagatagagaacatgaatctgaatttgcagaattatctggcttaacatttttttctttccagttttcactgtatcccccatgttgattcaatttaaaaaatatacctattttacttcaattcaacaatgctatgccagtacaaacccatacgttctattatttttgttttgttttgtttttgtatctccaccctgttacttcttttcttataaaattggtatttgaaatttattgaaatattttggaagagtgacataccatttttggtactttgtacctctgcacccttgggaagtgaccctggcttcacatttcataactgccttgtgaccatggccctcaagtggttgccagatggttgaagaacattaacctatctggctcaattttgtgaccatggattgaatcctctacataactgcagtgtgcaaaccacacatccgttccaagattgtagtcaggatatgaactttttaagaataaaacttcttcccttctgatctgggcctggtatgtggtcctactagaaccacatcacctactcttggtgctaacaatttgtggcaccaagttgttcaagtttcacccattaaagaaattccccgaccttgccttctcctcaggtaactaccccattctattttttctttcatagctaacattctctgctctcctggtctctctacttcactttcatttacatctcagctcctgaagtatggtttccaccatgttcctaaaactacattgcccagggtcactagagacctcttatgaaatataacaacacctttctacattacttccgtgtggaccactttttcacattgaacccattttgttggtttatgtacacaccccttccttggctttcccatctgatccatttctcctttgatggagaaggtgagtctgctccatatttagcttcttactctgagtaaccaaatgttatggatgggaggttagctctgtgtgtgagagaaaggtggagaagcatgtggggagggaaatagatgggaaaaggtaattaggctttatagaagggctctcattagcaagcttctaggggatgccaagatccatgcttagagattgccaggcttgtcttcaaatctcagctgtgtattactcctttatgttttttgtttgtttgtgttgtttgtttttgagacagagtctcgctgtgtcacccaggctggagtgtagtggtgtgatctcagctcactgcaaactctgcctcctgggttcaagcgaatctcagtctcctgagtagctgggactacaggcatgcaccaccaggcctggctaatttttgtagagacggggttttgctatgctggccaggctggtcttgaactcctgacctcaagtgatctgcccgccttggcctcccaaagtgttgggattagtggcgtgagccactgccccggcctattactcctttagagtgatttagagccatgtttacttatggtaacttgacagtaatgggaataaccactgatgaaacgtaaagcctttgtctaattgtttacctagttcttccttgtggttcatgaaatttttcatctctgtacagtttgaaaattaagatgataatatttagagatattttattcctttgtgaagagaaaaaaggctttcattaacagaaatcagtggcaataacttaataaatacaatcagctggtgttcctatagtatttaaaagaaaacagaaagtttactagatttcagccagttttcagactatttaatgtctattcttactataatagaaaatatataatttgatcttgttctcatttttcaaagacctttaatacatgattttagtagttgaaaatgaagtttaatgatagtttatgcctctacttttaaaaacaaagtctaacagatttttctcatgttaaatcacagaaaaagccacctgacattttaacttgtttttgatttgacagtgaaatcttataaatctgccacagttctaaaccaataaagatcaaggtataagggaaaaatgtagaatgtttgtgtgtttattttttccaccttgttctaagcacagcaatgagcattcgtaaaagccttactttatttgtccacccttttcattgttttttagaagcccaacacttttctttaacacatacaatgtggccttttcatgaaatcaattccctgcacagtgatatatggcagagcattgaattctgccaaatatctggctgagtgtttggtgttgtatggtctccatgagattttgtctctataatacttgggttaatctccttggatatacttgtgtgaatcaaactatgttaagggaaataggacaactaaaatatttgcacatgcaacttattggtcccactttttattcttttgcagagaatgggatagagagctggcttcaaagaaaaatcctaaactcattaatgcccttcggcgatgttttttctggagatttatgttctatggaatctttttatatttaggggtaaggatctcatttgtacattcattatgtatcacataactatattcatttttgtgattatgaaaagactacgaaatctggtgaataggtgtaaaaatataaaggatgaatccaactccaaacactaagaaaccacctaaaactctagtaaggataagtaaaaatcctttggaactaaaatgtcctggaacacgggtggcaatttacaatctcaatgggctcagcaaaataaattgcttgcttaaaaaattattttctgttatgattccaaatcacattatcttactagtacatgagattactggtgcctttattttgctgtattcaacaggagagtgtcaggagacaatgtcagcagaattaggtcaaatgcagctaattacatatatgaatgtttgtaatattttgaaatcatatctgcatggtgaattgtttcaaagaaaaacactaaaaatttaaagtatagcagctttaaatactaaataaataatactaaaaatttaaagttctcttgcaatatattttcttaatatcttacatctcatcagtgtgaaaagttgcacacctgaaaatccaggctttgtggtgtttaagtgccttgtatgttccccagttgctgtccaatgtgactctgatttattattttctacatcatgaaagcattatttgaatccttggttgtaacctataaaaggagacagattcaagacttgtttaatcttcttgttaaagctgtgcacaatatttgctttggggcgtttacttatcatatggattgacttgtgtttatattggtctttatgcctcagggagttaaacagtgtctcccagagaaatgccatttgtgttacattgcttgaaaaatttcagttcatacacccccatgaaaaatacatttaaaacttatcttaacaaagatgagtacacttaggcccagaatgttctctaatgctcttgataatttcctagaagaaatttttctgacttttgaaataatagatccataatatatattcttatggaaatctgaaaccatttgggcatttgggggtaaaaagtattttattagtaaatttaaatgaggtagctggataattaaattacttttaagttacctttgagatgatttttctcaatcagagcaccacccagagctttgagaaacaattttattcacagcttctgattctatttgatgtaatttttagaaaataagttttgctggttgctttgaatcagggtatggagtacagttcactctgatcctatcatataaatcatgtaagtatataacattttcaataagtgattgttggattgaagtgaatgatatttcaagtaattgttatgtcatggccaagatttcagtgaaactcaaaatttctcctggttgtgttctccattgcatgctgcttctattgattaacctaagcactactgagtagaagctggaagaggggtctaattagaaggcccctttctatgctctgcttggcttgtaaaataatttatttctctagatcccaccaacatagtagtttcatgtatgcaaaaacacccacctaaatgtcaaagtttgtatgatacatggacatatctatagaattttttttggtctggtgcatgccaaaaaataaacatgatatagaagaatttaatatttattgagtacctaatctgttccagttcaatatgaaggtctttatgcagattattttacttaattttcctagtaactccatggagcaaaaattatctctaatttatataacaggaagttgagcgtgaggcaaattaagtaactttcccaaagttacacatatggtaagtttgagagatatcccagtctctttagctccaaagcctttgaccctttcaccataccagattatgattgctattaatatataattataattataatgattgtatttaggtactcaacagaatggtgactctagtaaccagccttggttctgctgagcttctctgcgtcttctcaggagacacaggctacagagcttgaaggctgaggattcttccagggtcacttcaggggcaaatctgaaactttcttcaggacaggaatcaacgagatcttctcacttacttatacctgggggaggaactgtatgaaatccacccaagaaccagtcatgctaagggccaaacctatagacaaaaaaagggataggagaatggagtatgtatggagaaagactaaattgttcttaaacttctcaagcttaaaaatatcccagcaaaagagatcgtaaaagcccttcatggcgtattaattatccatgcatgggggtgagtggaaaggtactcctgagcccgaggctacagctttggaactagcagcacctttgaaggggaaagcgtgtttccatcatctcaactcctactgataaccaatggaatattggtgagtaaaggatcctgggggaagaagcagctgaaatgtgtaggtgagaaggcagagagaagaatatttatattgggaatggcacaagtgtgatgaggctgcaggtttttcacccttgtcatagagaaaaaaccacgctgacaccatgcagttttaaatagtgagaaatttgcaaattgttagatcttaaataatttagataaacatagtggccatttagattattgcagttttttcaggatatctgatctcttgatttcattctttttgtctcttataagaataaaagggggggagaaaatttagccattatagtatttctctacattttctctgtccttttacataacttacaccagtgccttcctatttatggtattatttatgggtatttcttcttttctttcactgagcaaggataaatgagccagggattcttgaaactactgtaacacttctcttagaaatagatggtcatactttcagaatctctacacattcttagtccctctaaacaatgatagttgtggcataaaaatatttgcttggtttcaggactgatagagaaaagtactataaaatttgctgttaactgtgaaaggttaaaaaaaaggaggtgccatcatgaaggagctaatctttctgaagtactgctgtagttttaaatattattagctatgacttctcaccattaactatgcacttgctttttcttcatctgactcagcagccagatagatgcaacattgtctttaacatttaagactcctagcaagtccgggcacgggggctcacacctgtaatcccagcactttgggaggccgaggtgggcaaatcacaaggtcaggagtttgagaccagcctggccaatatggtgaaaccctgtctctactaaaagtacaaaaatcagccaggtgtggtggcgtggtggcgggcacctgtggtcccagctacttgggaggctgaggcaggagaatagcttgaacctgggaggcagaggttgcagtgagctgagatcgcaccactgcactccagcctgggtgacagagcgagactccatctcaaaaaaaaaaaaaaaaaaaaagactcctag

SEQ ID NO: 52 - protein, 1060 aa, Artificial Sequence
  source: /note="Description of Artificial Sequence: Synthetic polypeptide"
  source: /note="nAPG00969"
MKQTSYSLGLAIGIASVGYGLIDNDENIVDAGVRLFPEANSKNNDGRRKSRGSKRLIRRKRHRIARVKHLLKESGIDVSYENTVLTNPYEIRCKGLTLPLTNHELSIALLHLAKRRGVHNVKSMDQEKVKGNELSTKEQLTINDNLLEEKFICELQLERLNKEGIVRSHSNRFKTADYIKEIKNLLETQAKQNTLVTEEFIEKYIEIFSGRRKYYEGPGGESKYGWKGDIEKWYEGLMGKCTYFPKELRCVKHAYSAALFNLLNDLNNLSINREEDTKLSQYEKEQIIEKIFKVRKTPTLTQIAKLLKVDPTNIKGFRTKANGTPDFLSIKIYHDLKGIIDDKQLLDDIAFLDNVAQILTVWQDSQSIQEKLKTLNKNLDDKTIKEISELKKYTQTHSLSLKLINVLLPELWETTKNQMTILSELKLKPRKIDLHNCNEIPVNMINDLIVSPVVRRSLTQSIEMINQIIKDYGHPREIVIELAREKNSEEKKNFIKSLNEKNKQINDEVIEKLNASNHRDNKGMFNKVKLWILQDGHCLYSLKPIRLEDLLNNPNHYEIDHIIPKSVSFDDSMSNKVLVYQIENSKKGNRTPYQYLTSADKTITYEKFKANITQLAKSNHKISKKKLDYLLEERDINRFHIKKEFINRNLVDTRYATRSLINLLKYYFSEKDINVKVKSINGSFTDYLRKLWNFPKDREFYHKHHAEDALIIAMANKIFTTRKIFKEQNSVFSDEQILDGEVTNILSDDQFQAEFTEKFYKVQAIKKYDKYKYSHRVDKKPNRQLFDDTLYSTREFEGEEYYIGKIKDIYNLKDKRLKKIFTKSPEKILMYQHDSQTFKKLKQIMRSYEDEVNPLAKYHKETGEYLRKECKKGNGPIVKSLKYRVTKLGVHKDITHKYENSKNKVVILSLKPFRMDVFKENGVYKFITIRYCDLKETVNSYTISEHLYKAKLKAKDIKSMDSFKWSFYKNDLLEYNGELCTFKGVNDDKKNKIEVNWVEKNFAIYAEKKNLKSKQLVKSITKSTVKSLLKYTTDILGNRYPVRNEKLKLMIRKQTFRGDL

SEQ ID NO: 53 - protein, 1092 aa, Artificial Sequence
  source: /note="Description of Artificial Sequence: Synthetic polypeptide"
  source: /note="nAPG06646"
MRYSIGLAIGTTSIGNAVINKDLQRFEHLGVRIFDAAENPKDGSSLSAPRRLARSSRRRLRRRKHRVERTKQLLINKGLLTKTQVKNLYNSKNINLDIWDIRVSGIDRKLFNNEFARVLIHFSKNRGFKSNRKSELKEDDNGAILSAVKENRELMDEKGYRTIAEMLVSDEKYEGTKRNKGGDYSHVVARSDIENEICLLFQKQREYGHPFATEENEEAFLSIWSSQRPFSTKDDIVKKIGNCTLEPKEKRAPKSTYTFERFRALDKLNRLRILSTTAPSRPLTNEERKSILSSLFSKKEVKYKELRKLLKLTDDQRFNEIYYSPDETIEKTENRTFLSLESQYKIKKIIEKTESKNMQSSYHPIDYDTIGYALTVFKDDKDIQHYLQNSYIDSKGKAIPNMANREYNLELIEELLGLSFAKFGHLSLKALNNILPYMEEGEPYHIACEMASYQFSQRLSKEKHRLLPPIPVDEIPNPVVVRALTQVRKVLNSIIKKYGPPSDIYIELAREMSKPFKERKSLEREFNENRQINEKAKAHISELYRIPNDPRPHDILKFKLWNEQNGICPYSLKPISIEYLFNIGYAEVDHIIPYSRSFDDSNGNKVLVLTRENQNKLNRTPYEWFGHEENRWEDFVSFIRTMKVGKKKKNMLLKKNFDEEQEEQILSRNLNDTRYITRYIKSFIEDNLEFRTEENKEQYVHTVNGAYTSLMRKRWGLNKDRRGNDLHHAVDAAIIAVSLPFKNKVNAYFKRQETGLSKLLNNKKDIFPEPWRNFIKELEARMIQDPEKMKRALESLELETYGEIFLNKLKPIFVSRMPKHSIKGQIHEETIRRVRGFTEEGFLVTVKKTRLDQIPFDKNGDFPMYGKETDIKTYMAIKQRYLEYGQDKQKAFAVPLRKPSKNPKNAPIVRSVKIEGKANRVVMLDDKAAADNASIVRTEVFRHKKTGEYYLTPVYVADILSNKIPDRLITIKKSYSDWDRITDEHEYLFSLYNNDLVKIILPKEKETKKYTGGNHLWQEGFFYFKGVDSSNAGIKIINHLNSFEARIGTKRLIAFEKYQVNPLGEINKVHGEKRPGELLNKEEIKENRKNIS

SEQ ID NO: 54 - protein, 1108 aa, Artificial Sequence
  source: /note="Description of Artificial Sequence: Synthetic polypeptide"
  source: /note="nAPG09748"
MAIRSIKLKLKTRTGPEAQNLRKGIWRTHRLLNEGVAYYMKMLLLFRQESTGGQTKKELQEELVRHIREQQQKNRADKNTQALPLDKAFAALRQLYELLVPSSIGQSGDAQIISRKFLSPLVDPNSEGGKGTSKAGAKPTWQKKKEANDPTWEQDYEKWKKRREEDPTASVITTLEEYGIRPIFPLYTNTVADIAWLPLQSNQFVRTWDRDMLQQAIERLLSWESWNKRVQEEYSKLQEKMTQLNEQLEGGQEWISLLEQYEEQREQELIENMTAANDKYRITKRQMKGWNELYEQWSTVLPNASHEQYREALKRVQQRLRGRFGDAHFFQYLMKEEHHLIWKGNPQRIHYFVARNELKKRLEEAKQNATMTLPDARKHPLWVRFDARGGNLQDYYLTAEADNPRSRRFVTFSQLIWPNESGWMEKQDVEVELALSKQFYQQVTLQKNDKGKQEIEFKDKGSGSTFSGHLGGAKLQLERGDLEKEEKDFEGGEIGSVYLNIVIDFEPLQEVKNGRLQSPYGQVLQLVRRPNEFPKVTTYKSEELVEWIKSSTKDSAGVESLESGFRVMSIALGLRTAAATSIFSVEESNDANAAGFSYWIEGTPLVAVHKRSYMLKLPGEQVEKQVREKRDERQDQQRRVRFQIRILSQVIRMAKKQNRERADELDHLSQALEKQKSLLDQTDRTFWNGIVCDLTDALREKEGGWEQAVVQIHRKAEEHVGKVVQAWRKRFDADERKGIAGLSMWSIEELDSLRKLLISWSRRTRNPREINCFEQGHTSHQRLLTHIQNVKEDRLKQLSHAIVMTALGYVYDEKKLEWFAKYPACQVILFENLSQYRSNMDRSTKENSTLMKWAHRSIPKYVHMQAEPYGIQIGDVRAEYSSRFHAKTGTPGIRCKMVSGHDLQGRRFENLQKRLISEQFLTEEQVKQLRPGDIVPDDSGEWFMTLSDGSEGKEVVFLQADINAAQNLQKRFWQRYNELFKVSCRVLIRGEEEYLIPKTKSVQAKLGKGLFVKKTDTVMKDVYVWDSQAKLKGKTTFTEESESPEQLEDFQEIIEEAEEAKGTYRTLFRDPSGVFFPEFVWSTQKDFWSEVKRRLYGKLRERFLMKTR

SEQ ID NO: 55 - protein, 1150 aa, Artificial Sequence
  source: /note="Description of Artificial Sequence: Synthetic polypeptide"
  source: /note="nAPG09882"
MYSIGLALGISSVGWSVIDERTGNVIDLGIRLFSAKNSEKNLERRTNRGGRRLIRRKTNRLKDAKKILAAVGFYEDKSLKNSCPYQLRVKGLTEPLSKGEIYKVTLHILKKRGISYLDEDDTEAAKESQDYKEQVRENAQLLTKYTPGQIQLQRLKENNRVKTGINAQGNYQLNVFKVSAYANELATILKTQQAFYPNELTDDWIALFVQPGIAEEAGLIYRKRPYYHGPGNEANNSPYGRWSDFKKTGQPATNIFDKLIGKDFQGELRASGLSLSAQQYNLLNDLTNLKIDGEIPLSPEQKEYILAELMTKEFTRFGVNDVVKLLGVKKERLSGWRLDKKGKPEIHTLKGYRNWRKIFAESGIDLATLPTETIDCLAKVLTLNTEREGIENTLAFELSELAESVKLLVLDRYKELSQSVSTQAWHRFSLKTLHLLIPELMNATSEQNTLLEQFQLKSDVRKRYSEYKKLPTKDVLTEIYNPTVNKTVSQAFKVIDALLVKYGKEQIRYITIEMPRDDNEEDEKKRIKELHAKNSQRKNDSQSYFMQKSGWSQEKFQTTIQKNRRFLAKLLYYYEQDGICAYTGLSISPELLVSDSTEIDHIIPISISLDDSINNKVLVLSKANQVKGQQTPYDAWMDGSFKKINGKFSNWDDYQKWVESCHFSHKKENNLLETRNIFDSEQVEKFLARNLNDTRYASRLVLNTLQSFFANQETKVRVVNGSFTHTLRKKWGADLDKTRETHHHHAVDATLCAVTPFVKVSRYHYAVKEETGEKVMREIDFETGEIVDEMSYREFKKSKKYERKTYQVKWPNFREQLKPVNLHPRIKFSHQVDRKANRKLSDATIYSVREKTEVKTLKSGKQKITTDEYTIGKIKDIYTVDGWEAFKKKQDKLLMKDLDEKTYERLLSIAETTPDFQEVEEKNGKVKRVKRSPFAVYCEENDIPAIRKYAKKNNGPLIRSLKYYDGKLNKHINITKDSQGRPVEKTKNGRKVTLQSLKPYRYDIYQDLETKAYYTVQLYYSDLRFVEGKYGITEKEYMKKVAEQTKGQVVRFCFSLQKNDGLEIEWKDSQCYDVRFYNFQSANSINFKGLEQEMMPAENQFKQKPYNNGAINLNIAKYGKEGKKLRKFNTDILGKKHYLYYEKEPKNIIK

SEQ ID NO: 56 - protein, 1068 aa, Artificial Sequence
  source: /note="Description of Artificial Sequence: Synthetic polypeptide"
  source: /note="nAPG03850"
MKYVLGLAIGIASCGWAVINQEKHRIEDLGVRIFDKAENPKDGKSLATPRRDARSTRRTLRRKKHRMQRIKILLVKHGLLSKTEIDHLYESATEIDVWYLRLNALERRLNPKEFARVLIHLAKRRGFKSNRKETTLSENGQILENISENLQIMEQQNYRTVGEMILKDKKFENHKRNKDGTYIGTVTRQQLKEEIQMIFNAQRLYKNDYATEEFESSYLEIWASQRPYASKDQIEKMIGYCTLEPKEKRVPKASWSFQYFVALQTINNLRLINKDRIEELSFEEKNQIMNLALEKSIVKYIDIRKLLSIPNEFHFNNLLYSADTVDTAVENKKCIEFKEYHSINKLYKQIYGKSVPNLLPIDYDTIACGLTIFKDDKDILAYLQNKYVNAKGKPISNLAKKTYDDTFIQALLTLNFSKMGHLSFKALKNIIPFLEEGLSYDKACEKAGYNFKGTSHAEKTKYLPVIPQNTNPVVHRALSQTRKVINAIIKKYGSPSAIHIETARELSKTFQERKEIDSMYQDNSKKNEHAIHKLKELGLINPSGINIVKFKLWNEQDGRCMYSGKYIEPHRLFEEGYTEVDHILPYSRSLDDSYNNKALTLGIENQRKGNKTPYEYIGKTSIWHEFETRVQSNKRINKKKQQKLLLQYFSYTREQEFIKRNLNDTRYATIYLSTLIQQHLIFSESSRKKKVHTVSGIITSHLRSRWGFNKDRKEGHIHHALDAVIVAVTSDHMIQRVTKYYKLKELNRNLQAKRMQFPEPWEGFRLELEARISPNTQQYLKRILFKNYADVNLSEIKPIFVSRMPKRSITGELHQETIRKLIGYNEKGKVLTAIKTKLEDIPFDANGDFPMYGKETDLYTYNAIKERYLSHKKDKRKSFQDPLYKPTKSGEIGPLIKSIKIMDTRTIVNPVNQGKGVVYNSKIARTDVFKKDEKYYLIPIYTIDLLKNILPQKAITAGKGYEDWTTIDPSFTFLFSLFPNDLIQIVPSKNKTIKARTTVSKKEVLLPSLTGYFKGVHSGTAGITVETHDGSVIANVGSKQLLLFEKYQVDVLGHYTKIKEEKRIGMVI

SEQ ID NO: 57 - protein, 1081 aa, Artificial Sequence
  source: /note="Description of Artificial Sequence: Synthetic polypeptide"
  source: /note="nAPG07553"
MQYVLGLAIGIASCGWAVINQEKERIEDLGVRIFDKAENPKDGKSLAAPRRDARSTRRTLRRKKHRMQRIKILLVKHGLLSQTELDHLYESATEVDVWNLRLDAIERKLNPKEFTRVLIHLAKRRGFKSNSKETTLSENGQILESISENQQIMEQKNYKTIGEMILKDKKFENHKRNKDGTYIGTVTRQQLQDEIQIIFNAQRLYKNNYATKEFESSYLEIWASQRPYASKDQIEKMIGYCTLEQKEKRVPRASWSFQYFVALHTINNLRLISKDRIEELSFKEKKQIMNLALEKPIVKYIDIRKLLSIPNELHFNSLLYSADTVDTTVENRKCIELKEYHSINKVYKQIYGKNALNLLPIDYDTIAYGLTIFKDDKDILEHLKNKYVNAKGKPINNLAKKTYDDTFIQALLTLNFSKMGHLSFKALKNIIPFLEEGLSYDKACEKAGYNFKGTSYTEQTKYLPVIPQNTNPVVHRALSQTKKVINAIIKKYGSPNAIHIETARELSKTFQERKEIDSMYQDNSKKNEHAIHKLKELGNINPSGINIVKFKLWNEQDGKCMYSGKYIEPHRLFEEGYTEVDHILPYSRSLDDSYNNKTLTLGIENQRKGNKTPYEYMGNTSIWDEYEIRVQSNKKINKKKQQKLLLQHFSYAREQEFIERNLNDTRYATIYLSSLIQQHLIFSESSRKKKVHTVSGIITSHLRSRWGFNKDRKEGHIHHALDAVIVAVTSDHMIQRVTKYYKLKELNRNLQAKRMPFPEPWEGFRLELEARISPNTQQYLKGLRFKNYADVNLCEIKPIFVSKMPKRSITGELHQETIRKFIGYNEKGKVLTAIKTKLEDIPFDANGDFPMYGKETDLYTYNSIKERYLSHKKDKRKSFQEPLYKPTKSGGIGPLIKSIKIMDTRTIVNPVNQGKGVVYNSKIARTDVFKKDDKYYLIPIYTIDLMKNILPQKAITAGKGYEDWITIDHSFTFLFSLFPNDLIKIVPSKNKEIKARSTSSKKEILLPSLIGYFKSVHSGTAGITVESHDGRFIANVGSKQLLLFEKYQVDVLGHYTKIKEEKRIGMATCNDNKKSTAFGSL

SEQ ID NO: 58 - protein, 1150 aa, Artificial Sequence
  source: /note="Description of Artificial Sequence: Synthetic polypeptide"
  source: /note="nAPG05586"
MYSIGLALGISSVGWSVIDEETGKIVDLGVRLFSAKNSEKNLERRTSRGARRLIRRKTNRLKDAKKLLEAIGFYEDKALKNVCPYQLRVKGLTEGLTKGELYKVVLHIVKKRGISYLDEDDAEAAKESQDYKEQVRKNAQLLTKYTPGQIQLQRLKENNRVKTGINGQGHYQLNVFKVSAYADELATILKTQQALYPNELTDDWIALFVQPGIAENAGLIYRKRPYYHGPGNEANNSPYGRWSDFQKTGQPAANIFDKLIGKDFQGELRASGLSLSAQQYNLLNDLTNLKIDGEVSLSPEQKEFILTELMTKEFARFGVNDIAKLLGVKKEQLSGWRLDKKGKPEIHTLKGYRNWRKIFAEAGIDLATLPTETIDCLAKVLTLNTEREGVENTLAFELPELAEPVKSLVLDHYKELSQSISTQAWHRFSLKTLHLLIPELIKSTSEQNTLLEQFQLKAGVRKRYSDYKKLPTKEVLAEIYNPTVNKTVSQAFKVMDALLEKYGKDQIHYITVEMPRDDNEEEERKRIKELQTKNSQRKNDSQQYFLQKSGWSQEKFQATIHKNRRFLAKLLYYFEQDGVCAYTGNPISPELLVSDSTEIDHIIPISISLDDSINNKVLVLSHANQVKGQQTPYDARMAGAFNKINGKFSNWDEYQKWVESRPFSRKKVNNLLETRNIFDSEQVQKFLSRNLNDTRYASRLVLNTLQSFFENQDTIVRVVNGSFTHTLRKKWGADLDKTRETHHHHAVDATLCAVTPFVKVSRYHYAVNEETGEKFMREIDVETGEILDEIPYREYKKAKHYERKTYQVKWSNFREQLKPITIHPKIKFSHQVDRKANRKLSDATIYSVREKTEVKTLKSGKEKITTDEYTIGKIKDIYTVDGWEAFKKKQDKLLMKEFDEKTYELLVTIAATTPDFQEVEEKNGKVKRVKRSPFAVYCEENGIPAIRKYAKKNNGPVIRSLKYYDGKLNKHINITKDEKGRPVEQTKNGRKVTLQSLKPYRYDIYQDLETKAYYTVQLYYSDLRFVEGEYGITEKEYMKKVAEQTKGQVVRFCFSLQKNDGLEIEWKDSQRYDVRFYNFQSANSINFKGLEQEMIPAENQFKQKPYNNGAINLNIAKYGKEGKKLRKFNTDILGKKHHLSYEKEPKNIIK

SEQ ID NO: 59 - protein, 1052 aa, Artificial Sequence
  source: /note="Description of Artificial Sequence: Synthetic polypeptide"
  source: /note="nAPG01604"
MVTKYILGLAIGITSVGYGIINYEDKTIIDAGVRLFPEANVENNEGRRSKRGARRLKRRRIHRLDRIKQLLSEYNLVDLDNIPQSPSPYEIRVKGLREELSKDELVIALLHIAKRRGIHNVEAVDETQDEGNELSTKEQLAKNNNLLKDKYVCELLLERLKDGKVRGEKNRFKTTDIIKEVKQLLETQKEAHQLDDDFINRYIDLIETRREYFEGPGKGSPFGWGGDLKKWYETLMGHCTYFPNELRSVKYSYSADLFNALNDLNNLVIQREGNSKLEYHEKYHIIENVFKQKKKPTLKQIANEIGVSPDDIKGFRINKSGKETFTEFKLYHDLKKVLIDQSILENVQLLDQIAEILTIYQDKESIINELNQLSEIINEQDKESISNLSGYNGTHRLSLKCINLVIEELWHTSRNQMEIFTYLNIKPKKIDLAKTNKIPKNMIDEFILSPVVKRTFGQAINVINKVIEKYGVPEDIIIELARESNSKDKQKFINSLQKKNETTRKRINEIIGQYGNQNAKRLVEKIRLHDEQEGKCLYSLESIPLEDLINNPQYYEVDHIIPRSVSFDNSYQNKVLVKQTENSKKSNRTPYQYFNSGETKLSYNQFKQHVLNLSKSKDRISKKKKEYLLEERDINKYEVQKEFINRNLVDTRYATRELTNYLKAYFSANDMDVKVKTINGSFTDYLRKVWKFKKERNHGYKHHAEDALIIANADFLFKENKKLKKANAILEQPSLDNGKSDATVENDNEYVETFSIPKQVNDIKEFRDFKFSHRVDKKPNRQLINDTLYSTRKIENHTFIVSPITNIYSKDNDELKKKFNKNPEKFLMYQHDPKTFEKLEVIMKQYANEKNPLAKYHEETGEYLTKYSKKNNGPIVKTIKVLGDKVGKHLDVTHKYKYSNSKIVKKTINPYRFDVYLTDKGYKFITISYLDVLKKDNYYYILKEKYEELKIKKSISDTDQFIGSFYYNDLIKINDQIFKVVGVNNDLLNRIELDLLDISYKEYCKINNIKTNRIIKGITKKITNIEKFSTDVLGNLYKAHSNHPQLIFKQRD

SEQ ID NO: 60 - protein, 1072 aa, Bacillus sp.
  source: /note="Bacillus sp. APG08290.1"
MSELDYRIGLDIGTNSIGWGVIELFWNKDRERYEKVRIVDKGVRMFDKAEIPNKGASLAEPRRIARSSRRRLNRKSQRKKEIRNLLVQHGMITQEELDLLYPLSKKSIDIWDIRLDGLDRLLNHLEWARLLIHLAQRRGFKSNRKSELKDAETGKVLSSIQVNEKRLFLYRTVGEMWIKDAEFSKYDRRRNSPNEYVFSVSRADLEKEIVTLFEAQRKFQSSYASKNLQETYLQIWAHQLPFASGNAILNKVGYCSLLKGKERRIPKATYTFQYFSALDQVNRTRLGPDFQPFTQEQKEIILDKMFQRTDYYKKKTIPEVSYYDIRKWLELDETIQFKGLNYDPNEELKKIEKKPFINLKAFYEIKKVVANYAERTNEAFSTLDYDAIAYALTVYKTDKDIRSYLKKSNNLSKRCYDDQLIEELFTLSYTKFGHLSFKAINHVLPIMQEGRTYQEAIHQLGYDTTNLKKENRSMFLPLIPDEITNPIVKRAITQARKVVNAIIRRYGSPNSVHIELARELSKSHDERKKIMTAHDENYKKNKGAISILIENGILNPTGYDIVRYKLWKEQGERCAYSLKEIPPDTFFNELKKERNGSPILEVDHILPYSQSFIDSYHNKVLVYSDENRNKGNRIPYTYFLETNKDWEAFERYVRSNKLFSKKKREYLLKKTYLPRESELIKERHLNDTRYASTFLKNFIEQNLQFKEVEVNLRKKRVQTVNGVITAHLRKRWGLEKNRQETYLHHAMDAIIVACTDHHMVTRITEYYQIKESNKSVKKPYFPMPWEGFRDELLSHLASQPIAKKISEELKAGYQSSDYIFVSRMPKRSVTGAAHDQTIRRKGGIDKKGKTIIIKRVRLKDIKFDENGDFKMVGKEQDLATYEAIKQRYLEHRKNSKKAFETPLYKPSKKGTGNLIKRVKIEGQTKAFVREVNGGVAQNSDLVRVDLFEKDDKYYMVPIYVPDTVCSELPKKVVKSGKGYEQWLTLDNSFTFKSSLYPYDLVRLVKGNEDRFLYFGTLDIDSDRLNFKDVNKPSKQNEYRYSLKTIENLEKYEVGVLGDLRLVKQETRRIFNR

SEQ ID NO: 61 - protein, 1072 aa, Artificial Sequence
  source: /note="Description of Artificial Sequence: Synthetic polypeptide"
  source: /note="nAPG08290.1"
MSELDYRIGLAIGTNSIGWGVIELFWNKDRERYEKVRIVDKGVRMFDKAEIPNKGASLAEPRRIARSSRRRLNRKSQRKKEIRNLLVQHGMITQEELDLLYPLSKKSIDIWDIRLDGLDRLLNHLEWARLLIHLAQRRGFKSNRKSELKDAETGKVLSSIQVNEKRLFLYRTVGEMWIKDAEFSKYDRRRNSPNEYVFSVSRADLEKEIVTLFEAQRKFQSSYASKNLQETYLQIWAHQLPFASGNAILNKVGYCSLLKGKERRIPKATYTFQYFSALDQVNRTRLGPDFQPFTQEQKEIILDKMFQRTDYYKKKTIPEVSYYDIRKWLELDETIQFKGLNYDPNEELKKIEKKPFINLKAFYEIKKVVANYAERTNEAFSTLDYDAIAYALTVYKTDKDIRSYLKKSNNLSKRCYDDQLIEELFTLSYTKFGHLSFKAINHVLPIMQEGRTYQEAIHQLGYDTTNLKKENRSMFLPLIPDEITNPIVKRAITQARKVVNAIIRRYGSPNSVHIELARELSKSHDERKKIMTAHDENYKKNKGAISILIENGILNPTGYDIVRYKLWKEQGERCAYSLKEIPPDTFFNELKKERNGSPILEVDHILPYSQSFIDSYHNKVLVYSDENRNKGNRIPYTYFLETNKDWEAFERYVRSNKLFSKKKREYLLKKTYLPRESELIKERHLNDTRYASTFLKNFIEQNLQFKEVEVNLRKKRVQTVNGVITAHLRKRWGLEKNRQETYLHHAMDAIIVACTDHHMVTRITEYYQIKESNKSVKKPYFPMPWEGFRDELLSHLASQPIAKKISEELKAGYQSSDYIFVSRMPKRSVTGAAHDQTIRRKGGIDKKGKTIIIKRVRLKDIKFDENGDFKMVGKEQDLATYEAIKQRYLEHRKNSKKAFETPLYKPSKKGTGNLIKRVKIEGQTKAFVREVNGGVAQNSDLVRVDLFEKDDKYYMVPIYVPDTVCSELPKKVVKSGKGYEQWLTLDNSFTFKSSLYPYDLVRLVKGNEDRFLYFGTLDIDSDRLNFKDVNKPSKQNEYRYSLKTIENLEKYEVGVLGDLRLVKQETRRIFNR

SEQ ID NO: 62 - DNA, 65 bp, Artificial Sequence
  source: /note="Description of Artificial Sequence: Synthetic oligonucleotide"
  source: /note="CF E60X nAPG06646 Target 1"
aatgagtttaggatttttctttgaagccagctatctatcccattctctgcaaaagaataaaaagt

SEQ ID NO: 63 - DNA, 65 bp, Artificial Sequence
  source: /note="Description of Artificial Sequence: Synthetic oligonucleotide"
  source: /note="CF E60X nAPG06646 Target 2"
attaatgagtttaggatttttctttgaagccagctatctatcccattctctgcaaaagaataaaa

SEQ ID NO: 64 - DNA, 65 bp, Artificial Sequence
  source: /note="Description of Artificial Sequence: Synthetic oligonucleotide"
  source: /note="CF E60X nAPG06646 Target 3"
gcattaatgagtttaggatttttctttgaagccagctatctatcccattctctgcaaaagaataa

SEQ ID NO: 65 - DNA, 65 bp, Artificial Sequence
  source: /note="Description of Artificial Sequence: Synthetic oligonucleotide"
  source: /note="CF E60X nAPG06646 Target 4"
aagggcattaatgagtttaggatttttctttgaagccagctatctatcccattctctgcaaaaga

SEQ ID NO: 66 - DNA, 65 bp, Artificial Sequence
  source: /note="Description of Artificial Sequence: Synthetic oligonucleotide"
  source: /note="CF E60X nAPG06646 Target 5"
gaagggcattaatgagtttaggatttttctttgaagccagctatctatcccattctctgcaaaag

SEQ ID NO: 67 - DNA, 65 bp, Artificial Sequence
  source: /note="Description of Artificial Sequence: Synthetic oligonucleotide"
  source: /note="CF E60X nAPG06646 Target 6"
cgaagggcattaatgagtttaggatttttctttgaagccagctatctatcccattctctgcaaaa

SEQ ID NO: 68 - DNA, 65 bp, Artificial Sequence
  source: /note="Description of Artificial Sequence: Synthetic oligonucleotide"
  source: /note="CF E60X nAPG09882 Target 1"
gagtttaggatttttctttgaagccagctatctatcccattctctgcaaaagaataaaaagtggg

SEQ ID NO: 69 - DNA, 65 bp, Artificial Sequence
  source: /note="Description of Artificial Sequence: Synthetic oligonucleotide"
  source: /note="CF E60X nAPG09882 Target 2"
tgagtttaggatttttctttgaagccagctatctatcccattctctgcaaaagaataaaaagtgg

SEQ ID NO: 70 - DNA, 65 bp, Artificial Sequence
  source: /note="Description of Artificial Sequence: Synthetic oligonucleotide"
  source: /note="CF E60X nAPG09882 Target 3"
atgagtttaggatttttctttgaagccagctatctatcccattctctgcaaaagaataaaaagtg

SEQ ID NO: 71 - DNA, 65 bp, Artificial Sequence
  source: /note="Description of Artificial Sequence: Synthetic oligonucleotide"
  source: /note="CF E60X nAPG09882 Target 4"
agggcattaatgagtttaggatttttctttgaagccagctatctatcccattctctgcaaaagaa

SEQ ID NO: 72 - DNA, 65 bp, Artificial Sequence
  source: /note="Description of Artificial Sequence: Synthetic oligonucleotide"
  source: /note="CF E60X nAPG00969 Target 1"
gtttaggatttttctttgaagccagctatctatcccattctctgcaaaagaataaaaagtgggac

SEQ ID NO: 73 - DNA, 65 bp, Artificial Sequence
  source: /note="Description of Artificial Sequence: Synthetic oligonucleotide"
  source: /note="CF E60X nAPG00969 Target 2"
agtttaggatttttctttgaagccagctatctatcccattctctgcaaaagaataaaaagtggga

SEQ ID NO: 74 - DNA, 60 bp, Artificial Sequence
  source: /note="Description of Artificial Sequence: Synthetic oligonucleotide"
  source: /note="CF E60X nAPG03850 Target 1"
ggatttttctttgaagccagctatctatcccattctctgcaaaagaataaaaagtgggac

SEQ ID NO: 75 - DNA, 60 bp, Artificial Sequence
  source: /note="Description of Artificial Sequence: Synthetic oligonucleotide"
  source: /note="CF E60X nAPG03850 Target 2"
agtttaggatttttctttgaagccagctatctatcccattctctgcaaaagaataaaaag

SEQ ID NO: 76 - DNA, 65 bp, Artificial Sequence; identical to SEQ ID NO: 66
  source: /note="Description of Artificial Sequence: Synthetic oligonucleotide"
  source: /note="CF E60X nAPG07433.1 Target 1"

SEQ ID NO: 77 - DNA, 60 bp, Artificial Sequence
  source: /note="Description of Artificial Sequence: Synthetic oligonucleotide"
  source: /note="CF E60X nAPG09748Target 1"
gtcccactttttattcttttgcagagaatgggatagatagctggcttcaaagaaaaatcc

SEQ ID NO: 78 - DNA, 60 bp, Artificial Sequence; identical to SEQ ID NO: 75
  source: /note="Description of Artificial Sequence: Synthetic oligonucleotide"
  source: /note="CF E60X nAPG07553 Target 1"

SEQ ID NO: 79 - DNA, 60 bp, Artificial Sequence
  source: /note="Description of Artificial Sequence: Synthetic oligonucleotide"
  source: /note="CF E60X nAPG05586 Target 1"
tttaggatttttctttgaagccagctatctatcccattctctgcaaaagaataaaaagtg

SEQ ID NO: 80 - DNA, 25 bp, Artificial Sequence
  source: /note="Description of Artificial Sequence: Synthetic oligonucleotide"
  source: /note="CF E60X nAPG06646 Target 1"
ttgaagccagctatctatcccattc

SEQ ID NO: 81 - DNA, 25 bp, Artificial Sequence
  source: /note="Description of Artificial Sequence: Synthetic oligonucleotide"
  source: /note="CF E60X nAPG06646 Target 2"
tctttgaagccagctatctatccca

SEQ ID NO: 82 - DNA, 25 bp, Artificial Sequence
  source: /note="Description of Artificial Sequence: Synthetic oligonucleotide"
  source: /note="CF E60X nAPG06646 Target 3"
tttctttgaagccagctatctatcc

SEQ ID NO: 83 - DNA, 25 bp, Artificial Sequence
  source: /note="Description of Artificial Sequence: Synthetic oligonucleotide"
  source: /note="CF E60X nAPG06646 Target 4"
gatttttctttgaagccagctatct

SEQ ID NO: 84 - DNA, 25 bp, Artificial Sequence
  source: /note="Description of Artificial Sequence: Synthetic oligonucleotide"
  source: /note="CF E60X nAPG06646 Target 5"
ggatttttctttgaagccagctatc

SEQ ID NO: 85 - DNA, 25 bp, Artificial Sequence
  source: /note="Description of Artificial Sequence: Synthetic oligonucleotide"
  source: /note="CF E60X nAPG06646 Target 6"
aggatttttctttgaagccagctat

SEQ ID NO: 86 - DNA, 25 bp, Artificial Sequence
  source: /note="Description of Artificial Sequence: Synthetic oligonucleotide"
  source: /note="CF E60X nAPG09882 Target 1"
aagccagctatctatcccattctct

SEQ ID NO: 87 - DNA, 25 bp, Artificial Sequence
  source: /note="Description of Artificial Sequence: Synthetic oligonucleotide"
  source: /note="CF E60X nAPG09882 Target 2"
gaagccagctatctatcccattctc

SEQ ID NO: 88 - DNA, 25 bp, Artificial Sequence
  source: /note="Description of Artificial Sequence: Synthetic oligonucleotide"
  source: /note="CF E60X nAPG09882 Target 3"
tgaagccagctatctatcccattct

SEQ ID NO: 89 - DNA, 25 bp, Artificial Sequence
  source: /note="Description of Artificial Sequence: Synthetic oligonucleotide"
  source: /note="CF E60X nAPG09882 Target 4"
atttttctttgaagccagctatcta

SEQ ID NO: 90 - DNA, 25 bp, Artificial Sequence
  source: /note="Description of Artificial Sequence: Synthetic oligonucleotide"
  source: /note="CF E60X nAPG00969 Target 1"
gccagctatctatcccattctctgc

SEQ ID NO: 91 - DNA, 25 bp, Artificial Sequence
  source: /note="Description of Artificial Sequence: Synthetic oligonucleotide"
  source: /note="CF E60X nAPG00969 Target 2"
agccagctatctatcccattctctg

SEQ ID NO: 92 - DNA, 20 bp, Artificial Sequence
  source: /note="Description of Artificial Sequence: Synthetic oligonucleotide"
  source: /note="CF E60X nAPG03850 Target 1"
ctatctatcccattctctgc

SEQ ID NO: 93 - DNA, 20 bp, Artificial Sequence
  source: /note="Description of Artificial Sequence: Synthetic oligonucleotide"
  source: /note="CF E60X nAPG03850 Target 2"
agccagctatctatcccatt

SEQ ID NO: 94 - DNA, 25 bp, Artificial Sequence
  source: /note="Description of Artificial Sequence: Synthetic oligonucleotide"
  source: /note="CF E60X nAPG07433.1 Target 1"
ggatttttctttgaagccagctatc

SEQ ID NO: 95 - DNA, 20 bp, Artificial Sequence
  source: /note="Description of Artificial Sequence: Synthetic oligonucleotide"
  source: /note="CF E60X nAPG09748Target 1"
gcagagaatgggatagatag

SEQ ID NO: 96 - DNA, 20 bp, Artificial Sequence
  source: /note="Description of Artificial Sequence: Synthetic oligonucleotide"
  source: /note="CF E60X nAPG07553 Target 1"
agccagctatctatcccatt

SEQ ID NO: 97 - DNA, 20 bp, Artificial Sequence
  source: /note="Description of Artificial Sequence: Synthetic oligonucleotide"
  source: /note="CF E60X nAPG05586 Target 1"
ccagctatctatcccattct

SEQ ID NO: 98 - RNA, 164 nt, Artificial Sequence
  source: /note="Description of Artificial Sequence: Synthetic polynucleotide"
  source: /note="CF E60X nAPG06646 Target 1 sgRNA"
uugaagccagcuaucuaucccauucgccauaauuccucuguaaaacuuaaagaagguuuauagaguuauuaugguaaggcaauaugccguggcguuggggaucgccuauguccgguuuuaccggaucucccuaaaggugacuaacuuugguuagucaccuuuuu

SEQ ID NO: 99 - RNA, 164 nt, Artificial Sequence
  source: /note="Description of Artificial Sequence: Synthetic polynucleotide"
  source: /note="CF E60X nAPG06646 Target 2 sgRNA"
ucuuugaagccagcuaucuaucccagccauaauuccucuguaaaacuuaaagaagguuuauagaguuauuaugguaaggcaauaugccguggcguuggggaucgccuauguccgguuuuaccggaucucccuaaaggugacuaacuuugguuagucaccuuuuu

SEQ ID NO: 100 - RNA, 164 nt, Artificial Sequence
  source: /note="Description of Artificial Sequence: Synthetic polynucleotide"
  source: /note="CF E60X nAPG06646 Target 3 sgRNA"
uuucuuugaagccagcuaucuauccgccauaauuccucuguaaaacuuaaagaagguuuauagaguuauuaugguaaggcaauaugccguggcguuggggaucgccuauguccgguuuuaccggaucucccuaaaggugacuaacuuugguuagucaccuuuuu

SEQ ID NO: 101 - RNA, 164 nt, Artificial Sequence
  source: /note="Description of Artificial Sequence: Synthetic polynucleotide"
  source: /note="CF E60X nAPG06646 Target 4 sgRNA"
gauuuuucuuugaagccagcuaucugccauaauuccucuguaaaacuuaaagaagguuuauagaguuauuaugguaaggcaauaugccguggcguuggggaucgccuauguccgguuuuaccggaucucccuaaaggugacuaacuuugguuagucaccuuuuu

SEQ ID NO: 102 - RNA, 164 nt, Artificial Sequence
  source: /note="Description of Artificial Sequence: Synthetic polynucleotide"
  source: /note="CF E60X nAPG06646 Target 5 sgRNA"
ggauuuuucuuugaagccagcuaucgccauaauuccucuguaaaacuuaaagaagguuuauagaguuauuaugguaaggcaauaugccguggcguuggggaucgccuauguccgguuuuaccggaucucccuaaaggugacuaacuuugguuagucaccuuuuu

SEQ ID NO: 103 - RNA, 164 nt, Artificial Sequence
  source: /note="Description of Artificial Sequence: Synthetic polynucleotide"
  source: /note="CF E60X nAPG06646 Target 6 sgRNA"
aggauuuuucuuugaagccagcuaugccauaauuccucuguaaaacuuaaagaagguuuauagaguuauuaugguaaggcaauaugccguggcguuggggaucgccuauguccgguuuuaccggaucucccuaaaggugacuaacuuugguuagucaccuuuuu

SEQ ID NO: 104 - RNA, 118 nt, Artificial Sequence
  source: /note="Description of Artificial Sequence: Synthetic polynucleotide"
  source: /note="CF E60X nAPG09882 Target 1 sgRNA"
aagccagcuaucuaucccauucucuguuuuuguacucucaauaaaaaguuauugagaaucuacaaaaauaaggcauuuugccgaauuuaccgcccuacauauguagggcgguuuuuuu

SEQ ID NO: 105 - RNA, 118 nt, Artificial Sequence
  source: /note="Description of Artificial Sequence: Synthetic polynucleotide"
  source: /note="CF E60X nAPG09882 Target 2 sgRNA"
gaagccagcuaucuaucccauucucguuuuuguacucucaauaaaaaguuauugagaaucuacaaaaauaaggcauuuugccgaauuuaccgcccuacauauguagggcgguuuuuuu

SEQ ID NO: 106 - RNA, 118 nt, Artificial Sequence
  source: /note="Description of Artificial Sequence: Synthetic polynucleotide"
  source: /note="CF E60X nAPG09882 Target 3 sgRNA"
ugaagccagcuaucuaucccauucuguuuuuguacucucaauaaaaaguuauugagaaucuacaaaaauaaggcauuuugccgaauuuaccgcccuacauauguagggcgguuuuuuu

SEQ ID NO: 107 - RNA, 118 nt, Artificial Sequence
  source: /note="Description of Artificial Sequence: Synthetic polynucleotide"
  source: /note="CF E60X nAPG09882 Target 4 sgRNA"
auuuuucuuugaagccagcuaucuaguuuuuguacucucaauaaaaaguuauugagaaucuacaaaaauaaggcauuuugccgaauuuaccgcccuacauauguagggcgguuuuuuu

SEQ ID NO: 108 - RNA, 118 nt, Artificial Sequence
  source: /note="Description of Artificial Sequence: Synthetic polynucleotide"
  source: /note="CF E60X nAPG00969 Target 1 sgRNA"
gccagcuaucuaucccauucucugcguuuuaguacucugugaaagcacagaaucuacuaaaauaaggcauaaugccguauuuaaucccaucauaauucugaugggauuuuuuauauuu

SEQ ID NO: 109 - RNA, 118 nt, Artificial Sequence
  source: /note="Description of Artificial Sequence: Synthetic polynucleotide"
  source: /note="CF E60X nAPG00969 Target 2 sgRNA"
agccagcuaucuaucccauucucugguuuuaguacucugugaaagcacagaaucuacuaaaauaaggcauaaugccguauuuaaucccaucauaauucugaugggauuuuuuauauuu

SEQ ID NO: 110 - RNA, 163 nt, Artificial Sequence
  source: /note="Description of Artificial Sequence: Synthetic polynucleotide"
  source: /note="CF E60X nAPG03850 Target 1 sgRNA"
cuaucuaucccauucucugcgcuauaguuccauaagaaaaaaguuucuuaaguuacuauaguaagggcaaugacccguggcguuuggggaucgccuuauccugguauggauauucuccccaugugaaaagcaccuaagcauagcgcuauggugcuuuuauuuu

SEQ ID NO: 111 - RNA, 163 nt, Artificial Sequence
  source: /note="Description of Artificial Sequence: Synthetic polynucleotide"
  source: /note="CF E60X nAPG03850 Target 2 sgRNA"
agccagcuaucuaucccauugcuauaguuccauaagaaaaaaguuucuuaaguuacuauaguaagggcaaugacccguggcguuuggggaucgccuuauccugguauggauauucuccccaugugaaaagcaccuaagcauagcgcuauggugcuuuuauuuu

SEQ ID NO: 112 - RNA, 135 nt, Artificial Sequence
  source: /note="Description of Artificial Sequence: Synthetic polynucleotide"
  source: /note="CF E60X nAPG07433.1 Target 1 sgRNA"
ggauuuuucuuugaagccagcuaucgucauaguuccauuaaagccaaaaguggcuuugauguuucuaugauaaggguuucgacccguggcgucggggaucgccugcccauugaaaugggcuucuccccauuuauu

SEQ ID NO: 113 - RNA, 135 nt, Artificial Sequence
  source: /note="Description of Artificial Sequence: Synthetic polynucleotide"
  source: /note="CF E60X nAPG09748Target 1 sgRNA"
cgacgguuagaggccguaugucgauuugcuuuaauuucgugcgugugcauugucguccuccauuacagggcggcuaccacgaauagccacgaaguaaaagcuucguggcuagcacgcagagaaugggauagauag

SEQ ID NO: 114 - RNA, 151 nt, Artificial Sequence
  source: /note="Description of Artificial Sequence: Synthetic polynucleotide"
  source: /note="CF E60X nAPG07553 Target 1 sgRNA"
agccagcuaucuaucccauugcuauaguuccauaagaaagcuuaaguuacuauaguaagggcaaugacccguggcguuuggggaucgccucauccauuacggauauucuccccaugugaaaagcaccuaagcauaaggcuaaggugcuuuu

SEQ ID NO: 115 - RNA, 110 nt, Artificial Sequence
  source: /note="Description of Artificial Sequence: Synthetic polynucleotide"
  source: /note="CF E60X nAPG05586 Target 1 sgRNA"
ccagcuaucuaucccauucuguuauuguacucucaauaaaaaguuauugagaaucuacaauaauaaggcaucuugccgaauuuaccgcccuacauauguagggcgguuuu

SEQ ID NO: 116 - DNA, 65 bp, Artificial Sequence
  source: /note="Description of Artificial Sequence: Synthetic oligonucleotide"
  source: /note="CF G542X nAPG06646 Target 1"
cgttgacctccactcagtgtgattccaccttctcaaagaactatattgtctttctctgcaaactt

SEQ ID NO: 117 - DNA, 65 bp, Artificial Sequence
  source: /note="Description of Artificial Sequence: Synthetic oligonucleotide"
  source: /note="CF G542X nAPG06646 Target 2"
gacctccactcagtgtgattccaccttctcaaagaactatattgtctttctctgcaaacttggag

SEQ ID NO: 118 - DNA, 65 bp, Artificial Sequence
  source: /note="Description of Artificial Sequence: Synthetic oligonucleotide"
  source: /note="CF G542X nAPG06646 Target 3"
cctccactcagtgtgattccaccttctcaaagaactatattgtctttctctgcaaacttggagat

SEQ ID NO: 119 - DNA, 65 bp, Artificial Sequence
  source: /note="Description of Artificial Sequence: Synthetic oligonucleotide"
  source: /note="CF G542X nAPG06646 Target 4"
ccactcagtgtgattccaccttctcaaagaactatattgtctttctctgcaaacttggagatgtc

SEQ ID NO: 120 - DNA, 65 bp, Artificial Sequence
  source: /note="Description of Artificial Sequence: Synthetic oligonucleotide"
  source: /note="CF G542X nAPG09882 Target 1"
tcttgctcgttgacctccactcagtgtgattccaccttctcaaagaactatattgtctttctctg

SEQ ID NO: 121 - DNA, 65 bp, Artificial Sequence
  source: /note="Description of Artificial Sequence: Synthetic oligonucleotide"
  source: /note="CF G542X nAPG09882 Target 2"
ttgctcgttgacctccactcagtgtgattccaccttctcaaagaactatattgtctttctctgca

SEQ ID NO: 122 - DNA, 65 bp, Artificial Sequence
  source: /note="Description of Artificial Sequence: Synthetic oligonucleotide"
  source: /note="CF G542X nAPG09882 Target 3"
cactcagtgtgattccaccttctcaaagaactatattgtctttctctgcaaacttggagatgtcc

SEQ ID NO: 123 - DNA, 60 bp, Artificial Sequence
  source: /note="Description of Artificial Sequence: Synthetic oligonucleotide"
  source: /note="CF G542X nAPG03850 Target 1"
tgacctccactcagtgtgattccaccttctcaaagaactatattgtctttctctgcaaac

SEQ ID NO: 124 - DNA, 60 bp, Artificial Sequence
  source: /note="Description of Artificial Sequence: Synthetic oligonucleotide"
  source: /note="CF G542X nAPG03850 Target 2"
tcagtgtgattccaccttctcaaagaactatattgtctttctctgcaaacttggagatgt

SEQ ID NO: 125 - DNA, 60 bp, Artificial Sequence
  source: /note="Description of Artificial Sequence: Synthetic oligonucleotide"
  source: /note="CF G542X nAPG09748 Target 1"
agagaaagacaatatagttctttgagaaggtggaatcacactgagtggaggtcaacgagc

SEQ ID NO: 126 - DNA, 60 bp, Artificial Sequence; identical to SEQ ID NO: 124
  source: /note="Description of Artificial Sequence: Synthetic oligonucleotide"
  source: /note="CF G542X nAPG07553 Target 1"

SEQ ID NO: 127 - DNA, 60 bp, Artificial Sequence
  source: /note="Description of Artificial Sequence: Synthetic oligonucleotide"
  source: /note="CF G542X nAPG05586 Target 1"
cgttgacctccactcagtgtgattccaccttctcaaagaactatattgtctttctctgca

SEQ ID NO: 128 - DNA, 25 bp, Artificial Sequence
  source: /note="Description of Artificial Sequence: Synthetic oligonucleotide"
  source: /note="CF G542X nAPG06646 Target 1"
gattccaccttctcaaagaactata

SEQ ID NO: 129 - DNA, 25 bp, Artificial Sequence
  source: /note="Description of Artificial Sequence: Synthetic oligonucleotide"
  source: /note="CF G542X nAPG06646 Target 2"
ccaccttctcaaagaactatattgt

SEQ ID NO: 130 - DNA, 25 bp, Artificial Sequence
  source: /note="Description of Artificial Sequence: Synthetic oligonucleotide"
  source: /note="CF G542X nAPG06646 Target 3"
accttctcaaagaactatattgtct

SEQ ID NO: 131 - DNA, 25 bp, Artificial Sequence
  source: /note="Description of Artificial Sequence: Synthetic oligonucleotide"
  source: /note="CF G542X nAPG06646 Target 4"
ttctcaaagaactatattgtctttc

SEQ ID NO: 132 - DNA, 25 bp, Artificial Sequence
  source: /note="Description of Artificial Sequence: Synthetic oligonucleotide"
  source: /note="CF G542X nAPG09882 Target 1"
tcagtgtgattccaccttctcaaag

SEQ ID NO: 133 - DNA, 25 bp, Artificial Sequence
  source: /note="Description of Artificial Sequence: Synthetic oligonucleotide"
  source: /note="CF G542X nAPG09882 Target 2"
agtgtgattccaccttctcaaagaa

SEQ ID NO: 134 - DNA, 25 bp, Artificial Sequence
  source: /note="Description of Artificial Sequence: Synthetic oligonucleotide"
  source: /note="CF G542X nAPG09882 Target 3"
tctcaaagaactatattgtctttct

SEQ ID NO: 135 - DNA, 20 bp, Artificial Sequence
  source: /note="Description of Artificial Sequence: Synthetic oligonucleotide"
  source: /note="CF G542X nAPG03850 Target 1"
tccaccttctcaaagaacta

SEQ ID NO: 136 - DNA, 20 bp, Artificial Sequence
  source: /note="Description of Artificial Sequence: Synthetic oligonucleotide"
  source: /note="CF G542X nAPG03850 Target 2"
caaagaactatattgtcttt

SEQ ID NO: 137 - DNA, 20 bp, Artificial Sequence
  source: /note="Description of Artificial Sequence: Synthetic oligonucleotide"
  source: /note="CF G542X nAPG09748 Target 1"
tttgagaaggtggaatcaca

SEQ ID NO: 138 - DNA, 20 bp, Artificial Sequence
  source: /note="Description of Artificial Sequence: Synthetic oligonucleotide"
  source: /note="CF G542X nAPG07553 Target 1"
caaagaactatattgtcttt

SEQ ID NO: 139 - DNA, 20 bp, Artificial Sequence
  source: /note="Description of Artificial Sequence: Synthetic oligonucleotide"
  source: /note="CF G542X nAPG05586 Target 1"
gattccaccttctcaaagaa

SEQ ID NO: 140 - RNA, 164 nt, Artificial Sequence
  source: /note="Description of Artificial Sequence: Synthetic polynucleotide"
  source: /note="CF G542X nAPG06646 Target 1 sgRNA"
gauuccaccuucucaaagaacuauagccauaauuccucuguaaaacuuaaagaagguuuauagaguuauuaugguaaggcaauaugccguggcguuggggaucgccuauguccgguuuuaccggaucucccuaaaggugacuaacuuugguuagucaccuuuuu

SEQ ID NO: 141 - RNA, 164 nt, Artificial Sequence
  source: /note="Description of Artificial Sequence: Synthetic polynucleotide"
  source: /note="CF G542X nAPG06646 Target 2 sgRNA"
ccaccuucucaaagaacuauauugugccauaauuccucuguaaaacuuaaagaagguuuauagaguuauuaugguaaggcaauaugccguggcguuggggaucgccuauguccgguuuuaccggaucucccuaaaggugacuaacuuugguuagucaccuuuuu

SEQ ID NO: 142 - RNA, 164 nt, Artificial Sequence
  source: /note="Description of Artificial Sequence: Synthetic polynucleotide"
  source: /note="CF G542X nAPG06646 Target 3 sgRNA"
accuucucaaagaacuauauugucugccauaauuccucuguaaaacuuaaagaagguuuauagaguuauuaugguaaggcaauaugccguggcguuggggaucgccuauguccgguuuuaccggaucucccuaaaggugacuaacuuugguuagucaccuuuuu

SEQ ID NO: 143 - RNA, 164 nt, Artificial Sequence
  source: /note="Description of Artificial Sequence: Synthetic polynucleotide"
  source: /note="CF G542X nAPG06646 Target 4 sgRNA"
uucucaaagaacuauauugucuuucgccauaauuccucuguaaaacuuaaagaagguuuauagaguuauuaugguaaggcaauaugccguggcguuggggaucgccuauguccgguuuuaccggaucucccuaaaggugacuaacuuugguuagucaccuuuuu

SEQ ID NO: 144 - RNA, 118 nt, Artificial Sequence
  source: /note="Description of Artificial Sequence: Synthetic polynucleotide"
  source: /note="CF G542X nAPG09882 Target 1 sgRNA"
ucagugugauuccaccuucucaaagguuuuuguacucucaauaaaaaguuauugagaaucuacaaaaauaaggcauuuugccgaauuuaccgcccuacauauguagggcgguuuuuuu

SEQ ID NO: 145 - RNA, 118 nt, Artificial Sequence
  source: /note="Description of Artificial Sequence: Synthetic polynucleotide"
  source: /note="CF G542X nAPG09882 Target 2 sgRNA"
agugugauuccaccuucucaaagaaguuuuuguacucucaauaaaaaguuauugagaaucuacaaaaauaaggcauuuugccgaauuuaccgcccuacauauguagggcgguuuuuuu

SEQ ID NO: 146 - RNA, 118 nt, Artificial Sequence
  source: /note="Description of Artificial Sequence: Synthetic polynucleotide"
  source: /note="CF G542X nAPG09882 Target 3 sgRNA"
ucucaaagaacuauauugucuuucuguuuuuguacucucaauaaaaaguuauugagaaucuacaaaaauaaggcauuuugccgaauuuaccgcccuacauauguagggcgguuuuuuu

SEQ ID NO: 147 - RNA, 163 nt, Artificial Sequence
  source: /note="Description of Artificial Sequence: Synthetic polynucleotide"
  source: /note="CF G542X nAPG03850 Target 1 sgRNA"
uccaccuucucaaagaacuagcuauaguuccauaagaaaaaaguuucuuaaguuacuauaguaagggcaaugacccguggcguuuggggaucgccuuauccugguauggauauucuccccaugugaaaagcaccuaagcauagcgcuauggugcuuuuauuuu

SEQ ID NO: 148 - RNA, 163 nt, Artificial Sequence
  source: /note="Description of Artificial Sequence: Synthetic polynucleotide"
  source: /note="CF G542X nAPG03850 Target 2 sgRNA"
caaagaacuauauugucuuugcuauaguuccauaagaaaaaaguuucuuaaguuacuauaguaagggcaaugacccguggcguuuggggaucgccuuauccugguauggauauucuccccaugugaaaagcaccuaagcauagcgcuauggugcuuuuauuuu

SEQ ID NO: 149 - RNA, 135 nt, Artificial Sequence
  source: /note="Description of Artificial Sequence: Synthetic polynucleotide"
  source: /note="CF G542X nAPG09748 Target 1 sgRNA"
cgacgguuagaggccguaugucgauuugcuuuaauuucgugcgugugcauugucguccuccauuacagggcggcuaccacgaauagccacgaaguaaaagcuucguggcuagcacuuugagaagguggaaucaca

SEQ ID NO: 150 - RNA, 151 nt, Artificial Sequence
  source: /note="Description of Artificial Sequence: Synthetic polynucleotide"
  source: /note="CF G542X nAPG07553 Target 1 sgRNA"
caaagaacuauauugucuuugcuauaguuccauaagaaagcuuaaguuacuauaguaagggcaaugacccguggcguuuggggaucgccucauccauuacggauauucuccccaugugaaaagcaccuaagcauaaggcuaaggugcuuuu

SEQ ID NO: 151 - RNA, 110 nt, Artificial Sequence
  source: /note="Description of Artificial Sequence: Synthetic polynucleotide"
  source: /note="CF G542X nAPG05586 Target 1 sgRNA"
gauuccaccuucucaaagaaguuauuguacucucaauaaaaaguuauugagaaucuacaauaauaaggcaucuugccgaauuuaccgcccuacauauguagggcgguuuu

SEQ ID NO: 152 - DNA, 65 bp, Artificial Sequence
  source: /note="Description of Artificial Sequence: Synthetic oligonucleotide"
  source: /note="CF Q493X nAPG09882 Target 1"
gatattttctttaatggtgccaggcataatccaggaaaactaagaacagaatgaaattcttccac

SEQ ID NO: 153 - DNA, 65 bp, Artificial Sequence
  source: /note="Description of Artificial Sequence: Synthetic oligonucleotide"
  source: /note="CF Q493X nAPG09882 Target 2"
atattttctttaatggtgccaggcataatccaggaaaactaagaacagaatgaaattcttccact

SEQ ID NO: 154 - DNA, 65 bp, Artificial Sequence
  source: /note="Description of Artificial Sequence: Synthetic oligonucleotide"
  source: /note="CF Q493X nAPG09882 Target 3"
ttttctttaatggtgccaggcataatccaggaaaactaagaacagaatgaaattcttccactgtg

SEQ ID NO: 155 - DNA, 65 bp, Artificial Sequence
  source: /note="Description of Artificial Sequence: Synthetic oligonucleotide"
  source: /note="CF Q493X nAPG09882 Target 4"
tttctttaatggtgccaggcataatccaggaaaactaagaacagaatgaaattcttccactgtgc

SEQ ID NO: 156 - DNA, 65 bp, Artificial Sequence
  source: /note="Description of Artificial Sequence: Synthetic oligonucleotide"
  source: /note="CF Q493X nAPG09882 Target 5"
ttctttaatggtgccaggcataatccaggaaaactaagaacagaatgaaattcttccactgtgct

SEQ ID NO: 157 - DNA, 60 bp, Artificial Sequence
  source: /note="Description of Artificial Sequence: Synthetic oligonucleotide"
  source: /note="CF Q493X nAPG09748 Target 1"
taagcacagtggaagaatttcattctgttcttagttttcctggattatgcctggcaccat

SEQ ID NO: 158 - DNA, 60 bp, Artificial Sequence
  source: /note="Description of Artificial Sequence: Synthetic oligonucleotide"
  source: /note="CF Q493X nAPG09748 Target 2"
aagcacagtggaagaatttcattctgttcttagttttcctggattatgcctggcaccatt

SEQ ID NO: 159 - DNA, 60 bp, Artificial Sequence
  source: /note="Description of Artificial Sequence: Synthetic oligonucleotide"
  source: /note="CF Q493X nAPG09748 Target 3"
acagtggaagaatttcattctgttcttagttttcctggattatgcctggcaccattaaag

SEQ ID NO: 160 - DNA, 60 bp, Artificial Sequence
  source: /note="Description of Artificial Sequence: Synthetic oligonucleotide"
  source: /note="CF Q493X nAPG09748 Target 4"
ggaagaatttcattctgttcttagttttcctggattatgcctggcaccattaaagaaaat

SEQ ID NO: 161 - DNA, 65 bp, Artificial Sequence; identical to SEQ ID NO: 152
  source: /note="Description of Artificial Sequence: Synthetic oligonucleotide"
  source: /note="CF Q493X nAPG00969 Target 1"

SEQ ID NO: 162 - DNA, 65 bp, Artificial Sequence; identical to SEQ ID NO: 156
  source: /note="Description of Artificial Sequence: Synthetic oligonucleotide"
  source: /note="CF Q493X nAPG00969 Target 2"

SEQ ID NO: 163 - DNA, 65 bp, Artificial Sequence
  source: /note="Description of Artificial Sequence: Synthetic oligonucleotide"
  source: /note="CF Q493X nAPG06646 Target 1"
tttaatggtgccaggcataatccaggaaaactaagaacagaatgaaattcttccactgtgcttaa

SEQ ID NO: 164 - DNA, 65 bp, Artificial Sequence
  source: /note="Description of Artificial Sequence: Synthetic oligonucleotide"
  source: /note="CF Q493X nAPG06646 Target 2"
aatggtgccaggcataatccaggaaaactaagaacagaatgaaattcttccactgtgcttaattt

SEQ ID NO: 165 - DNA, 60 bp, Artificial Sequence
  source: /note="Description of Artificial Sequence: Synthetic oligonucleotide"
  source: /note="CF Q493X nAPG01604 Target 1"
ttctttaatggtgccaggcataatccaggaaaactaagaacagaatgaaattcttccact

SEQ ID NO: 166 - DNA, 60 bp, Artificial Sequence
  source: /note="Description of Artificial Sequence: Synthetic oligonucleotide"
  source: /note="CF Q493X nAPG01604 Target 2"
ttaatggtgccaggcataatccaggaaaactaagaacagaatgaaattcttccactgtgc

SEQ ID NO: 167 - DNA, 60 bp, Artificial Sequence
  source: /note="Description of Artificial Sequence: Synthetic oligonucleotide"
  source: /note="CF Q493X nAPG03850 Target 1"
ctttaatggtgccaggcataatccaggaaaactaagaacagaatgaaattcttccactgt

SEQ ID NO: 168 - DNA, 60 bp, Artificial Sequence; identical to SEQ ID NO: 167
  source: /note="Description of Artificial Sequence: Synthetic oligonucleotide"
  source: /note="CF Q493X nAPG07553 Target 1"

SEQ ID NO: 169 - DNA, 25 bp, Artificial Sequence
  source: /note="Description of Artificial Sequence: Synthetic oligonucleotide"
  source: /note="CF Q493X nAPG09882 Target 1"
caggcataatccaggaaaactaaga

SEQ ID NO: 170 - DNA, 25 bp, Artificial Sequence
  source: /note="Description of Artificial Sequence: Synthetic oligonucleotide"
  source: /note="CF Q493X nAPG09882 Target 2"
aggcataatccaggaaaactaagaa

SEQ ID NO: 171 - DNA, 25 bp, Artificial Sequence
  source: /note="Description of Artificial Sequence: Synthetic oligonucleotide"
  source: /note="CF Q493X nAPG09882 Target 3"
cataatccaggaaaactaagaacag

SEQ ID NO: 172 - DNA, 25 bp, Artificial Sequence
  source: /note="Description of Artificial Sequence: Synthetic oligonucleotide"
  source: /note="CF Q493X nAPG09882 Target 4"
ataatccaggaaaactaagaacaga

SEQ ID NO: 173 - DNA, 25 bp, Artificial Sequence
  source: /note="Description of Artificial Sequence: Synthetic oligonucleotide"
  source: /note="CF Q493X nAPG09882 Target 5"
taatccaggaaaactaagaacagaa

SEQ ID NO: 174 - DNA, 20 bp, Artificial Sequence
  source: /note="Description of Artificial Sequence: Synthetic oligonucleotide"
  source: /note="CF Q493X nAPG09748 Target 1"
cattctgttcttagttttcc

SEQ ID NO: 175 - DNA, 20 bp, Artificial Sequence
  source: /note="Description of Artificial Sequence: Synthetic oligonucleotide"
  source: /note="CF Q493X nAPG09748 Target 2"
attctgttcttagttttcct

SEQ ID NO: 176 - DNA, 20 bp, Artificial Sequence
  source: /note="Description of Artificial Sequence: Synthetic oligonucleotide"
  source: /note="CF Q493X nAPG09748 Target 3"
tgttcttagttttcctggat

SEQ ID NO: 177 - DNA, 20 bp, Artificial Sequence
  source: /note="Description of Artificial Sequence: Synthetic oligonucleotide"
  source: /note="CF Q493X nAPG09748 Target 4"
ttagttttcctggattatgc

SEQ ID NO: 178 - DNA, 25 bp, Artificial Sequence
  source: /note="Description of Artificial Sequence: Synthetic oligonucleotide"
  source: /note="CF Q493X nAPG00969 Target 1"
caggcataatccaggaaaactaaga

SEQ ID NO: 179 - DNA, 25 bp, Artificial Sequence
  source: /note="Description of Artificial Sequence: Synthetic oligonucleotide"
  source: /note="CF Q493X nAPG00969 Target 2"
taatccaggaaaactaagaacagaa

SEQ ID NO: 180 - DNA, 25 bp, Artificial Sequence
  source: /note="Description of Artificial Sequence: Synthetic oligonucleotide"
  source: /note="CF Q493X nAPG06646 Target 1"
tccaggaaaactaagaacagaatga

SEQ ID NO: 181 - DNA, 25 bp, Artificial Sequence
  source: /note="Description of Artificial Sequence: Synthetic oligonucleotide"
  source: /note="CF Q493X nAPG06646 Target 2"
aggaaaactaagaacagaatgaaat

SEQ ID NO: 182 - DNA, 20 bp, Artificial Sequence
  source: /note="Description of Artificial Sequence: Synthetic oligonucleotide"
  source: /note="CF Q493X nAPG01604 Target 1"
taatccaggaaaactaagaa

SEQ ID NO: 183 - DNA, 20 bp, Artificial Sequence
  source: /note="Description of Artificial Sequence: Synthetic oligonucleotide"
  source: /note="CF Q493X nAPG01604 Target 2"
ccaggaaaactaagaacaga

SEQ ID NO: 184 - DNA, 20 bp, Artificial Sequence
  source: /note="Description of Artificial Sequence: Synthetic oligonucleotide"
  source: /note="CF Q493X nAPG03850 Target 1"
atccaggaaaactaagaaca

SEQ ID NO: 185 - DNA, 20 bp, Artificial Sequence
  source: /note="Description of Artificial Sequence: Synthetic oligonucleotide"
  source: /note="CF Q493X nAPG07553 Target 1"
atccaggaaaactaagaaca

SEQ ID NO: 186 - RNA, 118 nt, Artificial Sequence
  source: /note="Description of Artificial Sequence: Synthetic polynucleotide"
  source: /note="CF Q493X nAPG09882 Target 1 sgRNA"
caggcauaauccaggaaaacuaagaguuuuuguacucucaauaaaaaguuauugagaaucuacaaaaauaaggcauuuugccgaauuuaccgcccuacauauguagggcgguuuuuuu

SEQ ID NO: 187 - RNA, 118 nt, Artificial Sequence
  source: /note="Description of Artificial Sequence: Synthetic polynucleotide"
  source: /note="CF Q493X nAPG09882 Target 2 sgRNA"
aggcauaauccaggaaaacuaagaaguuuuuguacucucaauaaaaaguuauugagaaucuacaaaaauaaggcauuuugccgaauuuaccgcccuacauauguagggcgguuuuuuu

SEQ ID NO: 188 - RNA, 118 nt, Artificial Sequence
  source: /note="Description of Artificial Sequence: Synthetic polynucleotide"
  source: /note="CF Q493X nAPG09882 Target 3 sgRNA"
cauaauccaggaaaacuaagaacagguuuuuguacucucaauaaaaaguuauugagaaucuacaaaaauaaggcauuuugccgaauuuaccgcccuacauauguagggcgguuuuuuu

SEQ ID NO: 189 - RNA, 118 nt, Artificial Sequence
  source: /note="Description of Artificial Sequence: Synthetic polynucleotide"
  source: /note="CF Q493X nAPG09882 Target 4 sgRNA"
auaauccaggaaaacuaagaacagaguuuuuguacucucaauaaaaaguuauugagaaucuacaaaaauaaggcauuuugccgaauuuaccgcccuacauauguagggcgguuuuuuu

SEQ ID NO: 190 - RNA, 118 nt, Artificial Sequence
  source: /note="Description of Artificial Sequence: Synthetic polynucleotide"
  source: /note="CF Q493X nAPG09882 Target 5 sgRNA"
uaauccaggaaaacuaagaacagaaguuuuuguacucucaauaaaaaguuauugagaaucuacaaaaauaaggcauuuugccgaauuuaccgcccuacauauguagggcgguuuuuuu

SEQ ID NO: 191 - RNA, 135 nt, Artificial Sequence
  source: /note="Description of Artificial Sequence: Synthetic polynucleotide"
  source: /note="CF Q493X nAPG09748 Target 1 sgRNA"
cgacgguuagaggccguaugucgauuugcuuuaauuucgugcgugugcauugucguccuccauuacagggcggcuaccacgaauagccacgaaguaaaagcuucguggcuagcaccauucuguucuuaguuuucc

SEQ ID NO: 192 - RNA, 135 nt, Artificial Sequence
  source: /note="Description of Artificial Sequence: Synthetic polynucleotide"
  source: /note="CF Q493X nAPG09748 Target 2 sgRNA"
cgacgguuagaggccguaugucgauuugcuuuaauuucgugcgugugcauugucguccuccauuacagggcggcuaccacgaauagccacgaaguaaaagcuucguggcuagcacauucuguucuuaguuuuccu

SEQ ID NO: 193 - RNA, 135 nt, Artificial Sequence
  source: /note="Description of Artificial Sequence: Synthetic polynucleotide"
  source: /note="CF Q493X nAPG09748 Target 3 sgRNA"
cgacgguuagaggccguaugucgauuugcuuuaauuucgugcgugugcauugucguccuccauuacagggcggcuaccacgaauagccacgaaguaaaagcuucguggcuagcacuguucuuaguuuuccuggau

SEQ ID NO: 194 - RNA, 135 nt, Artificial Sequence
  source: /note="Description of Artificial Sequence: Synthetic polynucleotide"
  source: /note="CF Q493X nAPG09748 Target 4 sgRNA"
cgacgguuagaggccguaugucgauuugcuuuaauuucgugcgugugcauugucguccuccauuacagggcggcuaccacgaauagccacgaaguaaaagcuucguggcuagcacuuaguuuuccuggauuaugc

SEQ ID NO: 195 - RNA, 118 nt, Artificial Sequence
  source: /note="Description of Artificial Sequence: Synthetic polynucleotide"
  source: /note="CF Q493X nAPG00969 Target 1 sgRNA"
caggcauaauccaggaaaacuaagaguuuuaguacucugugaaagcacagaaucuacuaaaauaaggcauaaugccguauuuaaucccaucauaauucugaugggauuuuuuauauuu

SEQ ID NO: 196 - RNA, 118 nt, Artificial Sequence
  source: /note="Description of Artificial Sequence: Synthetic polynucleotide"
  source: /note="CF Q493X nAPG00969 Target 2 sgRNA"
uaauccaggaaaacuaagaacagaaguuuuaguacucugugaaagcacagaaucuacuaaaauaaggcauaaugccguauuuaaucccaucauaauucugaugggauuuuuuauauuu

SEQ ID NO: 197 - RNA, 164 nt, Artificial Sequence
  source: /note="Description of Artificial Sequence: Synthetic polynucleotide"
  source: /note="CF Q493X nAPG06646 Target 1 sgRNA"
uccaggaaaacuaagaacagaaugagccauaauuccucuguaaaacuuaaagaagguuuauagaguuauuaugguaaggcaauaugccguggcguuggggaucgccuauguccgguuuuaccggaucucccuaaaggugacuaacuuugguuagucaccuuuuu

SEQ ID NO: 198 - RNA, 164 nt, Artificial Sequence
  source: /note="Description of Artificial Sequence: Synthetic polynucleotide"
  source: /note="CF Q493X nAPG06646 Target 2 sgRNA"
aggaaaacuaagaacagaaugaaaugccauaauuccucuguaaaacuuaaagaagguuuauagaguuauuaugguaaggcaauaugccguggcguuggggaucgccuauguccgguuuuaccggaucucccuaaaggugacuaacuuugguuagucaccuuuuu

SEQ ID NO: 199 - RNA, 105 nt, Artificial Sequence
  source: /note="Description of Artificial Sequence: Synthetic polynucleotide"
  source: /note="CF Q493X nAPG01604 Target 1 sgRNA"
uaauccaggaaaacuaagaaguuuuaguacucuguaaaaaguuacagaaucuacuaaaacaaggcaaaaugccguguuuaucucgucaacuuguuggcgagauuu

SEQ ID NO: 200 - RNA, 105 nt, Artificial Sequence
  source: /note="Description of Artificial Sequence: Synthetic polynucleotide"
  source: /note="CF Q493X nAPG01604 Target 2 sgRNA"
ccaggaaaacuaagaacagaguuuuaguacucuguaaaaaguuacagaaucuacuaaaacaaggcaaaaugccguguuuaucucgucaacuuguuggcgagauuu

SEQ ID NO: 201 - RNA, 163 nt, Artificial Sequence
  source: /note="Description of Artificial Sequence: Synthetic polynucleotide"
  source: /note="CF Q493X nAPG03850 Target 1 sgRNA"
auccaggaaaacuaagaacagcuauaguuccauaagaaaaaaguuucuuaaguuacuauaguaagggcaaugacccguggcguuuggggaucgccuuauccugguauggauauucuccccaugugaaaagcaccuaagcauagcgcuauggugcuuuuauuuu

SEQ ID NO: 202 - RNA, 151 nt, Artificial Sequence
  source: /note="Description of Artificial Sequence: Synthetic polynucleotide"
  source: /note="CF Q493X nAPG07553 Target 1 sgRNA"
auccaggaaaacuaagaacagcuauaguuccauaagaaagcuuaaguuacuauaguaagggcaaugacccguggcguuuggggaucgccucauccauuacggauauucuccccaugugaaaagcaccuaagcauaaggcuaaggugcuuuu

SEQ ID NO: 203 - DNA, 65 bp, Artificial Sequence
  source: /note="Description of Artificial Sequence: Synthetic oligonucleotide"
  source: /note="CF R553X nAPG06646 Target 1"
ccaataattagttattcaccttgctaaagaaattcttgctcattgacctccactcagtgtgattc

SEQ ID NO: 204 - DNA, 65 bp, Artificial Sequence
  source: /note="Description of Artificial Sequence: Synthetic oligonucleotide"
  source: /note="CF R553X nAPG06646 Target 2"
caataattagttattcaccttgctaaagaaattcttgctcattgacctccactcagtgtgattcc

SEQ ID NO: 205 - DNA, 65 bp, Artificial Sequence
  source: /note="Description of Artificial Sequence: Synthetic oligonucleotide"
  source: /note="CF R553X nAPG06646 Target 3"
ataattagttattcaccttgctaaagaaattcttgctcattgacctccactcagtgtgattccac

SEQ ID NO: 206 - DNA, 65 bp, Artificial Sequence
  source: /note="Description of Artificial Sequence: Synthetic oligonucleotide"
  source: /note="CF R553X nAPG06646 Target 4"
aattagttattcaccttgctaaagaaattcttgctcattgacctccactcagtgtgattccacct

SEQ ID NO: 207 - DNA, 65 bp, Artificial Sequence
  source: /note="Description of Artificial Sequence: Synthetic oligonucleotide"
  source: /note="CF R553X nAPG06646 Target 5"
tcaccttgctaaagaaattcttgctcattgacctccactcagtgtgattccaccttctccaagaa

SEQ ID NO: 208 - DNA, 65 bp, Artificial Sequence
  source: /note="Description of Artificial Sequence: Synthetic oligonucleotide"
  source: /note="CF R553X nAPG06646 Target 6"
caccttgctaaagaaattcttgctcattgacctccactcagtgtgattccaccttctccaagaac

SEQ ID NO: 209 - DNA, 65 bp, Artificial Sequence
  source: /note="Description of Artificial Sequence: Synthetic oligonucleotide"
  source: /note="CF R553X nAPG06646 Target 7"
ccttgctaaagaaattcttgctcattgacctccactcagtgtgattccaccttctccaagaacta

SEQ ID NO: 210 - DNA, 65 bp, Artificial Sequence; identical to SEQ ID NO: 203
  source: /note="Description of Artificial Sequence: Synthetic oligonucleotide"
  source: /note="CF R553X nAPG07433.1 Target 1"

SEQ ID NO: 211 - DNA, 65 bp, Artificial Sequence; identical to SEQ ID NO: 207
  source: /note="Description of Artificial Sequence: Synthetic oligonucleotide"
  source: /note="CF R553X nAPG07433.1 Target 2"

SEQ ID NO: 212 - DNA, 65 bp, Artificial Sequence; identical to SEQ ID NO: 209
  source: /note="Description of Artificial Sequence: Synthetic oligonucleotide"
  source: /note="CF R553X nAPG07433.1 Target 3"

SEQ ID NO: 213 - DNA, 65 bp, Artificial Sequence
  source: /note="Description of Artificial Sequence: Synthetic oligonucleotide"
  source: /note="CF R553X nAPG09882 Target 1"
aataattagttattcaccttgctaaagaaattcttgctcattgacctccactcagtgtgattcca

SEQ ID NO: 214 - DNA, 65 bp, Artificial Sequence
  source: /note="Description of Artificial Sequence: Synthetic oligonucleotide"
  source: /note="CF R553X nAPG09882 Target 2"
attagttattcaccttgctaaagaaattcttgctcattgacctccactcagtgtgattccacctt

SEQ ID NO: 215 - DNA, 65 bp, Artificial Sequence
  source: /note="Description of Artificial Sequence: Synthetic oligonucleotide"
  source: /note="CF R553X nAPG09882 Target 3"
tattcaccttgctaaagaaattcttgctcattgacctccactcagtgtgattccaccttctccaa

SEQ ID NO: 216 - DNA, 60 bp, Artificial Sequence
  source: /note="Description of Artificial Sequence: Synthetic oligonucleotide"
  source: /note="CF R553X nAPG03850 Target 1"
tattcaccttgctaaagaaattcttgctcattgacctccactcagtgtgattccaccttc

SEQ ID NO: 217 - DNA, 60 bp, Artificial Sequence
  source: /note="Description of Artificial Sequence: Synthetic oligonucleotide"
  source: /note="CF R553X nAPG03850 Target 2"
ttcaccttgctaaagaaattcttgctcattgacctccactcagtgtgattccaccttctc

SEQ ID NO: 218 - DNA, 60 bp, Artificial Sequence
  source: /note="Description of Artificial Sequence: Synthetic oligonucleotide"
  source: /note="CF R553X nAPG03850 Target 3"
caccttgctaaagaaattcttgctcattgacctccactcagtgtgattccaccttctcca

SEQ ID NO: 219 - DNA, 25 bp, Artificial Sequence
  source: /note="Description of Artificial Sequence: Synthetic oligonucleotide"
  source: /note="CF R553X nAPG06646 Target 1"
ttgctaaagaaattcttgctcattg

SEQ ID NO: 220 - DNA, 25 bp, Artificial Sequence
  source: /note="Description of Artificial Sequence: Synthetic oligonucleotide"
  source: /note="CF R553X nAPG06646 Target 2"
tgctaaagaaattcttgctcattga

SEQ ID NO: 221 - DNA, 25 bp, Artificial Sequence
  source: /note="Description of Artificial Sequence: Synthetic oligonucleotide"
  source: /note="CF R553X nAPG06646 Target 3"
ctaaagaaattcttgctcattgacc

SEQ ID NO: 222 - DNA, 25 bp, Artificial Sequence
  source: /note="Description of Artificial Sequence: Synthetic oligonucleotide"
  source: /note="CF R553X nAPG06646 Target 4"
aaagaaattcttgctcattgacctc

SEQ ID NO: 223 - DNA, 25 bp, Artificial Sequence
  source: /note="Description of Artificial Sequence: Synthetic oligonucleotide"
  source: /note="CF R553X nAPG06646 Target 5"
ttgctcattgacctccactcagtgt

SEQ ID NO: 224 - DNA, 25 bp, Artificial Sequence
  source: /note="Description of Artificial Sequence: Synthetic oligonucleotide"
  source: /note="CF R553X nAPG06646 Target 6"
tgctcattgacctccactcagtgtg

SEQ ID NO: 225 - DNA, 25 bp, Artificial Sequence
  source: /note="Description of Artificial Sequence: Synthetic oligonucleotide"
  source: /note="CF R553X nAPG06646 Target 7"
ctcattgacctccactcagtgtgat

SEQ ID NO: 226 - DNA, 25 bp, Artificial Sequence
  source: /note="Description of Artificial Sequence: Synthetic oligonucleotide"
  source: /note="CF R553X nAPG07433.1 Target 1"
ttgctaaagaaattcttgctcattg

SEQ ID NO: 227 - DNA, 25 bp, Artificial Sequence
  source: /note="Description of Artificial Sequence: Synthetic oligonucleotide"
  source: /note="CF R553X nAPG07433.1 Target 2"
ttgctcattgacctccactcagtgt

SEQ ID NO: 228 - DNA, 25 bp, Artificial Sequence
  source: /note="Description of Artificial Sequence: Synthetic oligonucleotide"
  source: /note="CF R553X nAPG07433.1 Target 3"
ctcattgacctccactcagtgtgat

SEQ ID NO: 229 - DNA, 25 bp, Artificial Sequence
  source: /note="Description of Artificial Sequence: Synthetic oligonucleotide"
  source: /note="CF R553X nAPG09882 Target 1"
gctaaagaaattcttgctcattgac

SEQ ID NO: 230 - DNA, 25 bp, Artificial Sequence
  source: /note="Description of Artificial Sequence: Synthetic oligonucleotide"
  source: /note="CF R553X nAPG09882 Target 2"
aagaaattcttgctcattgacctcc

SEQ ID NO: 231 - DNA, 25 bp, Artificial Sequence
  source: /note="Description of Artificial Sequence: Synthetic oligonucleotide"
  source: /note="CF R553X nAPG09882 Target 3"
ttcttgctcattgacctccactcag

SEQ ID NO: 232 - DNA, 20 bp, Artificial Sequence
  source: /note="Description of Artificial Sequence: Synthetic oligonucleotide"
  source: /note="CF R553X nAPG03850 Target 1"
ttcttgctcattgacctcca

SEQ ID NO: 233 - DNA, 20 bp, Artificial Sequence
  source: /note="Description of Artificial Sequence: Synthetic oligonucleotide"
  source: /note="CF R553X nAPG03850 Target 2"
cttgctcattgacctccact

SEQ ID NO: 234 - DNA, 20 bp, Artificial Sequence
  source: /note="Description of Artificial Sequence: Synthetic oligonucleotide"
  source: /note="CF R553X nAPG03850 Target 3"
tgctcattgacctccactca

SEQ ID NO: 235 - RNA, 164 nt, Artificial Sequence
  source: /note="Description of Artificial Sequence: Synthetic polynucleotide"
  source: /note="CF R553X nAPG06646 Target 1 sgRNA"
uugcuaaagaaauucuugcucauuggccauaauuccucuguaaaacuuaaagaagguuuauagaguuauuaugguaaggcaauaugccguggcguuggggaucgccuauguccgguuuuaccggaucucccuaaaggugacuaacuuugguuagucaccuuuuu

SEQ ID NO: 236 - RNA, 164 nt, Artificial Sequence
  source: /note="Description of Artificial Sequence: Synthetic polynucleotide"
  source: /note="CF R553X nAPG06646 Target 2 sgRNA"
ugcuaaagaaauucuugcucauugagccauaauuccucuguaaaacuuaaagaagguuuauagaguuauuaugguaaggcaauaugccguggcguuggggaucgccuauguccgguuuuaccggaucucccuaaaggugacuaacuuugguuagucaccuuuuu

SEQ ID NO: 237 - RNA, 164 nt, Artificial Sequence
  source: /note="Description of Artificial Sequence: Synthetic polynucleotide"
  source: /note="CF R553X nAPG06646 Target 3 sgRNA"
cuaaagaaauucuugcucauugaccgccauaauuccucuguaaaacuuaaagaagguuuauagaguuauuaugguaaggcaauaugccguggcguuggggaucgccuauguccgguuuuaccggaucucccuaaaggugacuaacuuugguuagucaccuuuuu

SEQ ID NO: 238 - RNA, 164 nt, Artificial Sequence
  source: /note="Description of Artificial Sequence: Synthetic polynucleotide"
  source: /note="CF R553X nAPG06646 Target 4 sgRNA"
aaagaaauucuugcucauugaccucgccauaauuccucuguaaaacuuaaagaagguuuauagaguuauuaugguaaggcaauaugccguggcguuggggaucgccuauguccgguuuuaccggaucucccuaaaggugacuaacuuugguuagucaccuuuuu

SEQ ID NO: 239 - RNA, 164 nt, Artificial Sequence
  source: /note="Description of Artificial Sequence: Synthetic polynucleotide"
  source: /note="CF R553X nAPG06646 Target 5 sgRNA"
uugcucauugaccuccacucagugugccauaauuccucuguaaaacuuaaagaagguuuauagaguuauuaugguaaggcaauaugccguggcguuggggaucgccuauguccgguuuuaccggaucucccuaaaggugacuaacuuugguuagucaccuuuuu

SEQ ID NO: 240 - RNA, 164 nt, Artificial Sequence
  source: /note="Description of Artificial Sequence: Synthetic polynucleotide"
  source: /note="CF R553X nAPG06646 Target 6 sgRNA"
ugcucauugaccuccacucaguguggccauaauuccucuguaaaacuuaaagaagguuuauagaguuauuaugguaaggcaauaugccguggcguuggggaucgccuauguccgguuuuaccggaucucccuaaaggugacuaacuuugguuagucaccuuuuu

SEQ ID NO: 241 - RNA, 164 nt, Artificial Sequence
  source: /note="Description of Artificial Sequence: Synthetic polynucleotide"
  source: /note="CF R553X nAPG06646 Target 7 sgRNA"
cucauugaccuccacucagugugaugccauaauuccucuguaaaacuuaaagaagguuuauagaguuauuaugguaaggcaauaugccguggcguuggggaucgccuauguccgguuuuaccggaucucccuaaaggugacuaacuuugguuagucaccuuuuu

SEQ ID NO: 242 - RNA, 135 nt, Artificial Sequence
  source: /note="Description of Artificial Sequence: Synthetic polynucleotide"
  source: /note="CF R553X nAPG07433.1 Target 1 sgRNA"
uugcuaaagaaauucuugcucauuggucauaguuccauuaaagccaaaaguggcuuugauguuucuaugauaaggguuucgacccguggcgucggggaucgccugcccauugaaaugggcuucuccccauuuauu

SEQ ID NO: 243 - RNA, 135 nt, Artificial Sequence
  source: /note="Description of Artificial Sequence: Synthetic polynucleotide"
  source: /note="CF R553X nAPG07433.1 Target 2 sgRNA"
uugcucauugaccuccacucagugugucauaguuccauuaaagccaaaaguggcuuugauguuucuaugauaaggguuucgacccguggcgucggggaucgccugcccauugaaaugggcuucuccccauuuauu

SEQ ID NO: 244 - RNA, 135 nt, Artificial Sequence
  source: /note="Description of Artificial Sequence: Synthetic polynucleotide"
  source: /note="CF R553X nAPG07433.1 Target 3 sgRNA"
cucauugaccuccacucagugugaugucauaguuccauuaaagccaaaaguggcuuugauguuucuaugauaaggguuucgacccguggcgucggggaucgccugcccauugaaaugggcuucuccccauuuauu

SEQ ID NO: 245 - RNA, 118 nt, Artificial Sequence
  source: /note="Description of Artificial Sequence: Synthetic polynucleotide"
  source: /note="CF R553X nAPG09882 Target 1 sgRNA"
gcuaaagaaauucuugcucauugacguuuuuguacucucaauaaaaaguuauugagaaucuacaaaaauaaggcauuuugccgaauuuaccgcccuacauauguagggcgguuuuuuu

SEQ ID NO: 246 - RNA, 118 nt, Artificial Sequence
  source: /note="Description of Artificial Sequence: Synthetic polynucleotide"
  source: /note="CF R553X nAPG09882 Target 2 sgRNA"
aagaaauucuugcucauugaccuccguuuuuguacucucaauaaaaaguuauugagaaucuacaaaaauaaggcauuuugccgaauuuaccgcccuacauauguagggcgguuuuuuu

SEQ ID NO: 247 - RNA, 118 nt, Artificial Sequence
  source: /note="Description of Artificial Sequence: Synthetic polynucleotide"
  source: /note="CF R553X nAPG09882 Target 3 sgRNA"
uucuugcucauugaccuccacucagguuuuuguacucucaauaaaaaguuauugagaaucuacaaaaauaaggcauuuugccgaauuuaccgcccuacauauguagggcgguuuuuuu

SEQ ID NO: 248 - RNA, 163 nt, Artificial Sequence
  source: /note="Description of Artificial Sequence: Synthetic polynucleotide"
  source: /note="CF R553X nAPG03850 Target 1 sgRNA"
uucuugcucauugaccuccagcuauaguuccauaagaaaaaaguuucuuaaguuacuauaguaagggcaaugacccguggcguuuggggaucgccuuauccugguauggauauucuccccaugugaaaagcaccuaagcauagcgcuauggugcuuuuauuuu

SEQ ID NO: 249 - RNA, 163 nt, Artificial Sequence
  source: /note="Description of Artificial Sequence: Synthetic polynucleotide"
  source: /note="CF R553X nAPG03850 Target 2 sgRNA"
cuugcucauugaccuccacugcuauaguuccauaagaaaaaaguuucuuaaguuacuauaguaagggcaaugacccguggcguuuggggaucgccuuauccugguauggauauucuccccaugugaaaagcaccuaagcauagcgcuauggugcuuuuauuuu

SEQ ID NO: 250 - RNA, 163 nt, Artificial Sequence
  source: /note="Description of Artificial Sequence: Synthetic polynucleotide"
  source: /note="CF R553X nAPG03850 Target 3 sgRNA"
ugcucauugaccuccacucagcuauaguuccauaagaaaaaaguuucuuaaguuacuauaguaagggcaaugacccguggcguuuggggaucgccuuauccugguauggauauucuccccaugugaaaagcaccuaagcauagcgcuauggugcuuuuauuuu

SEQ ID NO: 251 - DNA, 65 bp, Artificial Sequence
  source: /note="Description of Artificial Sequence: Synthetic oligonucleotide"
  source: /note="CF R1162X nAPG09882 Target 1"
ggtttaccttctgttggcatgtcaatgaacttaaagactcagctcacagatcgcatctgaaataa

SEQ ID NO: 252 - DNA, 65 bp, Artificial Sequence
  source: /note="Description of Artificial Sequence: Synthetic oligonucleotide"
  source: /note="CF R1162X nAPG09882 Target 2"
accttctgttggcatgtcaatgaacttaaagactcagctcacagatcgcatctgaaataaaaata

SEQ ID NO: 253 - DNA, 65 bp, Artificial Sequence
  source: /note="Description of Artificial Sequence: Synthetic oligonucleotide"
  source: /note="CF R1162X nAPG09882 Target 3"
ctgttggcatgtcaatgaacttaaagactcagctcacagatcgcatctgaaataaaaataacaac

SEQ ID NO: 254 - DNA, 65 bp, Artificial Sequence
  source: /note="Description of Artificial Sequence: Synthetic oligonucleotide"
  source: /note="CF R1162X nAPG09882 Target 4"
tgttggcatgtcaatgaacttaaagactcagctcacagatcgcatctgaaataaaaataacaaca

SEQ ID NO: 255 - DNA, 65 bp, Artificial Sequence
  source: /note="Description of Artificial Sequence: Synthetic oligonucleotide"
  source: /note="CF R1162X nAPG09882 Target 5"
gttggcatgtcaatgaacttaaagactcagctcacagatcgcatctgaaataaaaataacaacat

SEQ ID NO: 256 - DNA, 65 bp, Artificial Sequence
  source: /note="Description of Artificial Sequence: Synthetic oligonucleotide"
  source: /note="CF R1162X nAPG06646 Target 1"
tttaccttctgttggcatgtcaatgaacttaaagactcagctcacagatcgcatctgaaataaaa

SEQ ID NO: 257 - DNA, 65 bp, Artificial Sequence
  source: /note="Description of Artificial Sequence: Synthetic oligonucleotide"
  source: /note="CF R1162X nAPG06646 Target 2"
taccttctgttggcatgtcaatgaacttaaagactcagctcacagatcgcatctgaaataaaaat

SEQ ID NO: 258 - DNA, 60 bp, Artificial Sequence
  source: /note="Description of Artificial Sequence: Synthetic oligonucleotide"
  source: /note="CF R1162X nAPG06646 Target 3"
tggcatgtcaatgaacttaaagactcagctcacagatcgcatctgaaataaaaataacaa

SEQ ID NO: 259 - DNA, 60 bp, Artificial Sequence
  source: /note="Description of Artificial Sequence: Synthetic oligonucleotide"
  source: /note="CF R1162X nAPG03850 Target 1"
taccttctgttggcatgtcaatgaacttaaagactcagctcacagatcgcatctgaaata

SEQ ID NO: 260 - DNA, 60 bp, Artificial Sequence
  source: /note="Description of Artificial Sequence: Synthetic oligonucleotide"
  source: /note="CF R1162X nAPG03850 Target 2"
ttctgttggcatgtcaatgaacttaaagactcagctcacagatcgcatctgaaataaaaa

SEQ ID NO: 261 - DNA, 60 bp, Artificial Sequence; identical to SEQ ID NO: 258
  source: /note="Description of Artificial Sequence: Synthetic oligonucleotide"
  source: /note="CF R1162X nAPG03850 Target 3"

SEQ ID NO: 262 - DNA, 60 bp, Artificial Sequence
  source: /note="Description of Artificial Sequence: Synthetic oligonucleotide"
  source: /note="CF R1162X nAPG05586 Target 1"
ttaccttctgttggcatgtcaatgaacttaaagactcagctcacagatcgcatctgaaat

SEQ ID NO: 263 - DNA, 60 bp, Artificial Sequence
  source: /note="Description of Artificial Sequence: Synthetic oligonucleotide"
  source: /note="CF R1162X nAPG05586 Target 2"
ctgttggcatgtcaatgaacttaaagactcagctcacagatcgcatctgaaataaaaata

SEQ ID NO: 264 - DNA, 60 bp, Artificial Sequence
  source: /note="Description of Artificial Sequence: Synthetic oligonucleotide"
  source: /note="CF R1162X nAPG05586 Target 3"
tgtcaatgaacttaaagactcagctcacagatcgcatctgaaataaaaataacaacattt

SEQ ID NO: 265 - DNA, 65 bp, Artificial Sequence; identical to SEQ ID NO: 251
  source: /note="Description of Artificial Sequence: Synthetic oligonucleotide"
  source: /note="CF R1162X nAPG00969 Target 1"

SEQ ID NO: 266 - DNA, 65 bp, Artificial Sequence; identical to SEQ ID NO: 255
  source: /note="Description of Artificial Sequence: Synthetic oligonucleotide"
  source: /note="CF R1162X nAPG00969 Target 2"

SEQ ID NO: 267 - DNA, 60 bp, Artificial Sequence; identical to SEQ ID NO: 258
  source: /note="Description of Artificial Sequence: Synthetic oligonucleotide"
  source: /note="CF R1162X nAPG07553 Target 1"

SEQ ID NO: 268 - DNA, 60 bp, Artificial Sequence
  source: /note="Description of Artificial Sequence: Synthetic oligonucleotide"
  source: /note="CF R1162X nAPG01604 Target 1"
gcatgtcaatgaacttaaagactcagctcacagatcgcatctgaaataaaaataacaaca

SEQ ID NO: 269 - DNA, 25 bp, Artificial Sequence
  source: /note="Description of Artificial Sequence: Synthetic oligonucleotide"
  source: /note="CF R1162X nAPG09882 Target 1"
gtcaatgaacttaaagactcagctc

SEQ ID NO: 270 - DNA, 25 bp, Artificial Sequence
  source: /note="Description of Artificial Sequence: Synthetic oligonucleotide"
  source: /note="CF R1162X nAPG09882 Target 2"
tgaacttaaagactcagctcacaga

SEQ ID NO: 271 - DNA, 25 bp, Artificial Sequence
  source: /note="Description of Artificial Sequence: Synthetic oligonucleotide"
  source: /note="CF R1162X nAPG09882 Target 3"
ttaaagactcagctcacagatcgca

SEQ ID NO: 272 - DNA, 25 bp, Artificial Sequence
  source: /note="Description of Artificial Sequence: Synthetic oligonucleotide"
  source: /note="CF R1162X nAPG09882 Target 4"
taaagactcagctcacagatcgcat

SEQ ID NO: 273 - DNA, 25 bp, Artificial Sequence
  source: /note="Description of Artificial Sequence: Synthetic oligonucleotide"
  source: /note="CF R1162X nAPG09882 Target 5"
aaagactcagctcacagatcgcatc

SEQ ID NO: 274 - DNA, 25 bp, Artificial Sequence
  source: /note="Description of Artificial Sequence: Synthetic oligonucleotide"
  source: /note="CF R1162X nAPG06646 Target 1"
caatgaacttaaagactcagctcac

SEQ ID NO: 275 - DNA, 25 bp, Artificial Sequence
  source: /note="Description of Artificial Sequence: Synthetic oligonucleotide"
  source: /note="CF R1162X nAPG06646 Target 2"
atgaacttaaagactcagctcacag

SEQ ID NO: 276 - DNA, 25 bp, Artificial Sequence
  source: /note="Description of Artificial Sequence: Synthetic oligonucleotide"
  source: /note="CF R1162X nAPG06646 Target 3"
aacttaaagactcagctcacagatc

SEQ ID NO: 277 - DNA, 20 bp, Artificial Sequence
  source: /note="Description of Artificial Sequence: Synthetic oligonucleotide"
  source: /note="CF R1162X nAPG03850 Target 1"
atgaacttaaagactcagct

SEQ ID NO: 278 - DNA, 20 bp, Artificial Sequence
  source: /note="Description of Artificial Sequence: Synthetic oligonucleotide"
  source: /note="CF R1162X nAPG03850 Target 2"
acttaaagactcagctcaca

SEQ ID NO: 279 - DNA, 20 bp, Artificial Sequence
  source: /note="Description of Artificial Sequence: Synthetic oligonucleotide"
  source: /note="CF R1162X nAPG03850 Target 3"
agactcagctcacagatcgc

SEQ ID NO: 280 - DNA, 20 bp, Artificial Sequence
  source: /note="Description of Artificial Sequence: Synthetic oligonucleotide"
  source: /note="CF R1162X nAPG05586 Target 1"
aatgaacttaaagactcagc

SEQ ID NO: 281 - DNA, 20 bp, Artificial Sequence
  source: /note="Description of Artificial Sequence: Synthetic oligonucleotide"
  source: /note="CF R1162X nAPG05586 Target 2"
ttaaagactcagctcacaga

SEQ ID NO: 282 - DNA, 20 bp, Artificial Sequence
  source: /note="Description of Artificial Sequence: Synthetic oligonucleotide"
  source: /note="CF R1162X nAPG05586 Target 3"
cagctcacagatcgcatctg

SEQ ID NO: 283 - DNA, 25 bp, Artificial Sequence
  source: /note="Description of Artificial Sequence: Synthetic oligonucleotide"
  source: /note="CF R1162X nAPG00969 Target 1"
gtcaatgaacttaaagactcagctc

SEQ ID NO: 284 - DNA, 25 bp, Artificial Sequence
  source: /note="Description of Artificial Sequence: Synthetic oligonucleotide"
  source: /note="CF R1162X nAPG00969 Target 2"
aaagactcagctcacagatcgcatc

SEQ ID NO: 285 - DNA, 20 bp, Artificial Sequence
  source: /note="Description of Artificial Sequence: Synthetic oligonucleotide"
  source: /note="CF R1162X nAPG07553 Target 1"
agactcagctcacagatcgc

SEQ ID NO: 286 - DNA, 20 bp, Artificial Sequence
  source: /note="Description of Artificial Sequence: Synthetic oligonucleotide"
  source: /note="CF R1162X nAPG01604 Target 1"
actcagctcacagatcgcat

SEQ ID NO: 287 - RNA, 118 nt, Artificial Sequence
  source: /note="Description of Artificial Sequence: Synthetic polynucleotide"
  source: /note="CF R1162X nAPG09882 Target 1 sgRNA"
gucaaugaacuuaaagacucagcucguuuuuguacucucaauaaaaaguuauugagaaucuacaaaaauaaggcauuuugccgaauuuaccgcccuacauauguagggcgguuuuuuu

SEQ ID NO: 288 - RNA, 118 nt, Artificial Sequence
  source: /note="Description of Artificial Sequence: Synthetic polynucleotide"
  source: /note="CF R1162X nAPG09882 Target 2 sgRNA"
ugaacuuaaagacucagcucacagaguuuuuguacucucaauaaaaaguuauugagaaucuacaaaaauaaggcauuuugccgaauuuaccgcccuacauauguagggcgguuuuuuu

SEQ ID NO: 289 - RNA, 118 nt, Artificial Sequence
  source: /note="Description of Artificial Sequence: Synthetic polynucleotide"
  source: /note="CF R1162X nAPG09882 Target 3 sgRNA"
uuaaagacucagcucacagaucgcaguuuuuguacucucaauaaaaaguuauugagaaucuacaaaaauaaggcauuuugccgaauuuaccgcccuacauauguagggcgguuuuuuu

SEQ ID NO: 290 - RNA, 118 nt, Artificial Sequence
  source: /note="Description of Artificial Sequence: Synthetic polynucleotide"
  source: /note="CF R1162X nAPG09882 Target 4 sgRNA"
uaaagacucagcucacagaucgcauguuuuuguacucucaauaaaaaguuauugagaaucuacaaaaauaaggcauuuugccgaauuuaccgcccuacauauguagggcgguuuuuuu

SEQ ID NO: 291 - RNA, 118 nt, Artificial Sequence
  source: /note="Description of Artificial Sequence: Synthetic polynucleotide"
  source: /note="CF R1162X nAPG09882 Target 5 sgRNA"
aaagacucagcucacagaucgcaucguuuuuguacucucaauaaaaaguuauugagaaucuacaaaaauaaggcauuuugccgaauuuaccgcccuacauauguagggcgguuuuuuu

SEQ ID NO: 292 - RNA, 164 nt, Artificial Sequence
  source: /note="Description of Artificial Sequence: Synthetic polynucleotide"
  source: /note="CF R1162X nAPG06646 Target 1 sgRNA"
caaugaacuuaaagacucagcucacgccauaauuccucuguaaaacuuaaagaagguuuauagaguuauuaugguaaggcaauaugccguggcguuggggaucgccuauguccgguuuuaccggaucucccuaaaggugacuaacuuugguuagucaccuuuuu

SEQ ID NO: 293 - RNA, 164 nt, Artificial Sequence
  source: /note="Description of Artificial Sequence: Synthetic polynucleotide"
  source: /note="CF R1162X nAPG06646 Target 2 sgRNA"
augaacuuaaagacucagcucacaggccauaauuccucuguaaaacuuaaagaagguuuauagaguuauuaugguaaggcaauaugccguggcguuggggaucgccuauguccgguuuuaccggaucucccuaaaggugacuaacuuugguuagucaccuuuuu

SEQ ID NO: 294 - RNA, 164 nt, Artificial Sequence
  source: /note="Description of Artificial Sequence: Synthetic polynucleotide"
  source: /note="CF R1162X nAPG06646 Target 3 sgRNA"
aacuuaaagacucagcucacagaucgccauaauuccucuguaaaacuuaaagaagguuuauagaguuauuaugguaaggcaauaugccguggcguuggggaucgccuauguccgguuuuaccggaucucccuaaaggugacuaacuuugguuagucaccuuuuu

SEQ ID NO: 295 - RNA, 163 nt, Artificial Sequence
  source: /note="Description of Artificial Sequence: Synthetic polynucleotide"
  source: /note="CF R1162X nAPG03850 Target 1 sgRNA"
augaacuuaaagacucagcugcuauaguuccauaagaaaaaaguuucuuaaguuacuauaguaagggcaaugacccguggcguuuggggaucgccuuauccugguauggauauucuccccaugugaaaagcaccuaagcauagcgcuauggugcuuuuauuuu

SEQ ID NO: 296 - RNA, 163 nt, Artificial Sequence
  source: /note="Description of Artificial Sequence: Synthetic polynucleotide"
  source: /note="CF R1162X nAPG03850 Target 2 sgRNA"
acuuaaagacucagcucacagcuauaguuccauaagaaaaaaguuucuuaaguuacuauaguaagggcaaugacccguggcguuuggggaucgccuuauccugguauggauauucuccccaugugaaaagcaccuaagcauagcgcuauggugcuuuuauuuu

SEQ ID NO: 297 - RNA, 163 nt, Artificial Sequence
  source: /note="Description of Artificial Sequence: Synthetic polynucleotide"
  source: /note="CF R1162X nAPG03850 Target 3 sgRNA"
agacucagcucacagaucgcgcuauaguuccauaagaaaaaaguuucuuaaguuacuauaguaagggcaaugacccguggcguuuggggaucgccuuauccugguauggauauucuccccaugugaaaagcaccuaagcauagcgcuauggugcuuuuauuuu

SEQ ID NO: 298 - RNA, 110 nt, Artificial Sequence
  source: /note="Description of Artificial Sequence: Synthetic polynucleotide"
  source: /note="CF R1162X nAPG05586 Target 1 sgRNA"
aaugaacuuaaagacucagcguuauuguacucucaauaaaaaguuauugagaaucuacaauaauaaggcaucuugccgaauuuaccgcccuacauauguagggcgguuuu

SEQ ID NO: 299 - RNA, 110 nt, Artificial Sequence
  source: /note="Description of Artificial Sequence: Synthetic polynucleotide"
  source: /note="CF R1162X nAPG05586 Target 2 sgRNA"
uuaaagacucagcucacagaguuauuguacucucaauaaaaaguuauugagaaucuacaauaauaaggcaucuugccgaauuuaccgcccuacauauguagggcgguuuu

SEQ ID NO: 300 - RNA, 110 nt, Artificial Sequence
  source: /note="Description of Artificial Sequence: Synthetic polynucleotide"
  source: /note="CF R1162X nAPG05586 Target 3 sgRNA"
cagcucacagaucgcaucugguuauuguacucucaauaaaaaguuauugagaaucuacaauaauaaggcaucuugccgaauuuaccgcccuacauauguagggcgguuuu

SEQ ID NO: 301 - RNA, 118 nt, Artificial Sequence
  source: /note="Description of Artificial Sequence: Synthetic polynucleotide"
  source: /note="CF R1162X nAPG00969 Target 1 sgRNA"
gucaaugaacuuaaagacucagcucguuuuaguacucugugaaagcacagaaucuacuaaaauaaggcauaaugccguauuuaaucccaucauaauucugaugggauuuuuuauauuu

SEQ ID NO: 302 - RNA, 118 nt, Artificial Sequence
  source: /note="Description of Artificial Sequence: Synthetic polynucleotide"
  source: /note="CF R1162X nAPG00969 Target 2 sgRNA"
aaagacucagcucacagaucgcaucguuuuaguacucugugaaagcacagaaucuacuaaaauaaggcauaaugccguauuuaaucccaucauaauucugaugggauuuuuuauauuu

SEQ ID NO: 303 - RNA, 151 nt, Artificial Sequence
  source: /note="Description of Artificial Sequence: Synthetic polynucleotide"
  source: /note="CF R1162X nAPG07553 Target 1 sgRNA"
agacucagcucacagaucgcgcuauaguuccauaagaaagcuuaaguuacuauaguaagggcaaugacccguggcguuuggggaucgccucauccauuacggauauucuccccaugugaaaagcaccuaagcauaaggcuaaggugcuuuu

SEQ ID NO: 304 - RNA, 105 nt, Artificial Sequence
  source: /note="Description of Artificial Sequence: Synthetic polynucleotide"
  source: /note="CF R1162X nAPG01604 Target 1 sgRNA"
acucagcucacagaucgcauguuuuaguacucuguaaaaaguuacagaaucuacuaaaacaaggcaaaaugccguguuuaucucgucaacuuguuggcgagauuu

SEQ ID NO: 305 - DNA, 65 bp, Artificial Sequence
  source: /note="Description of Artificial Sequence: Synthetic oligonucleotide"
  source: /note="CF W1282X nAPG09882 Target 1"
gtgtgtcttgggattcaataactttgcaacagtgaaggaaagcctttggagtgataccacaggtg

SEQ ID NO: 306 - DNA, 65 bp, Artificial Sequence
  source: /note="Description of Artificial Sequence: Synthetic oligonucleotide"
  source: /note="CF W1282X nAPG09882 Target 2"
gtcttgggattcaataactttgcaacagtgaaggaaagcctttggagtgataccacaggtgagca

SEQ ID NO: 307 - DNA, 65 bp, Artificial Sequence
  source: /note="Description of Artificial Sequence: Synthetic oligonucleotide"
  source: /note="CF W1282X nAPG09882 Target 3"
cttgggattcaataactttgcaacagtgaaggaaagcctttggagtgataccacaggtgagcaaa

SEQ ID NO: 308 - DNA, 65 bp, Artificial Sequence
  source: /note="Description of Artificial Sequence: Synthetic oligonucleotide"
  source: /note="CF W1282X nAPG09882 Target 4"
gggattcaataactttgcaacagtgaaggaaagcctttggagtgataccacaggtgagcaaaagg

SEQ ID NO: 309 - DNA, 65 bp, Artificial Sequence
  source: /note="Description of Artificial Sequence: Synthetic oligonucleotide"
  source: /note="CF W1282X nAPG09882 Target 5"
gattcaataactttgcaacagtgaaggaaagcctttggagtgataccacaggtgagcaaaaggac

SEQ ID NO: 310 - DNA, 65 bp, Artificial Sequence
  source: /note="Description of Artificial Sequence: Synthetic oligonucleotide"
  source: /note="CF W1282X nAPG06646 Target 1"
tcgatggtgtgtcttgggattcaataactttgcaacagtgaaggaaagcctttggagtgatacca

SEQ ID NO: 311 - DNA, 65 bp, Artificial Sequence
  source: /note="Description of Artificial Sequence: Synthetic oligonucleotide"
  source: /note="CF W1282X nAPG06646 Target 2"
ttgggattcaataactttgcaacagtgaaggaaagcctttggagtgataccacaggtgagcaaaa

SEQ ID NO: 312 - DNA, 65 bp, Artificial Sequence
  source: /note="Description of Artificial Sequence: Synthetic oligonucleotide"
  source: /note="CF W1282X nAPG06646 Target 3"
tgggattcaataactttgcaacagtgaaggaaagcctttggagtgataccacaggtgagcaaaag

SEQ ID NO: 313 - DNA, 65 bp, Artificial Sequence
  source: /note="Description of Artificial Sequence: Synthetic oligonucleotide"
  source: /note="CF W1282X nAPG06646 Target 4"
ggattcaataactttgcaacagtgaaggaaagcctttggagtgataccacaggtgagcaaaagga

SEQ ID NO: 314 - DNA, 60 bp, Artificial Sequence
  source: /note="Description of Artificial Sequence: Synthetic oligonucleotide"
  source: /note="CF W1282X nAPG03850 Target 1"
tgtcttgggattcaataactttgcaacagtgaaggaaagcctttggagtgataccacagg

SEQ ID NO: 315 - DNA, 60 bp, Artificial Sequence
  source: /note="Description of Artificial Sequence: Synthetic oligonucleotide"
  source: /note="CF W1282X nAPG03850 Target 2"
gtcttgggattcaataactttgcaacagtgaaggaaagcctttggagtgataccacaggt

SEQ ID NO: 316 - DNA, 60 bp, Artificial Sequence
  source: /note="Description of Artificial Sequence: Synthetic oligonucleotide"
  source: /note="CF W1282X nAPG03850 Target 3"
cttgggattcaataactttgcaacagtgaaggaaagcctttggagtgataccacaggtga

SEQ ID NO: 317 - DNA, 60 bp, Artificial Sequence
  source: /note="Description of Artificial Sequence: Synthetic oligonucleotide"
  source: /note="CF W1282X nAPG03850 Target 4"
tgggattcaataactttgcaacagtgaaggaaagcctttggagtgataccacaggtgagc

SEQ ID NO: 318 - DNA, 60 bp, Artificial Sequence; identical to SEQ ID NO: 316
  source: /note="Description of Artificial Sequence: Synthetic oligonucleotide"
  source: /note="CF W1282X nAPG07553 Target 1"

SEQ ID NO: 319 - DNA, 60 bp, Artificial Sequence; identical to SEQ ID NO: 317
  source: /note="Description of Artificial Sequence: Synthetic oligonucleotide"
  source: /note="CF W1282X nAPG07553 Target 2"

SEQ ID NO: 320 - DNA, 60 bp, Artificial Sequence
  source: /note="Description of Artificial Sequence: Synthetic oligonucleotide"
  source: /note="CF W1282X nAPG01604 Target 1"
tcttgggattcaataactttgcaacagtgaaggaaagcctttggagtgataccacaggtg

SEQ ID NO: 321 - DNA, 60 bp, Artificial Sequence; identical to SEQ ID NO: 316
  source: /note="Description of Artificial Sequence: Synthetic oligonucleotide"
  source: /note="CF W1282X nAPG01604 Target 2"

SEQ ID NO: 322 - DNA, 65 bp, Artificial Sequence; identical to SEQ ID NO: 311
  source: /note="Description of Artificial Sequence: Synthetic oligonucleotide"
  source: /note="CF W1282X nAPG07433.1 Target 1"

SEQ ID NO: 323 - DNA, 60 bp, Artificial Sequence
  source: /note="Description of Artificial Sequence: Synthetic oligonucleotide"
  source: /note="CF W1282X nAPG09748 Target 1"
gtatcactccaaaggctttccttcactgttgcaaagttattgaatcccaagacacaccat

SEQ ID NO: 324 - DNA, 60 bp, Artificial Sequence
  source: /note="Description of Artificial Sequence: Synthetic oligonucleotide"
  source: /note="CF W1282X nAPG05586 Target 1"
gattcaataactttgcaacagtgaaggaaagcctttggagtgataccacaggtgagcaaa

SEQ ID NO: 325 - DNA, 25 bp, Artificial Sequence
  source: /note="Description of Artificial Sequence: Synthetic oligonucleotide"
  source: /note="CF W1282X nAPG09882 Target 1"
actttgcaacagtgaaggaaagcct

SEQ ID NO: 326 - DNA, 25 bp, Artificial Sequence
  source: /note="Description of Artificial Sequence: Synthetic oligonucleotide"
  source: /note="CF W1282X nAPG09882 Target 2"
tgcaacagtgaaggaaagcctttgg

SEQ ID NO: 327 - DNA, 25 bp, Artificial Sequence
  source: /note="Description of Artificial Sequence: Synthetic oligonucleotide"
  source: /note="CF W1282X nAPG09882 Target 3"
caacagtgaaggaaagcctttggag

SEQ ID NO: 328 - DNA, 25 bp, Artificial Sequence
  source: /note="Description of Artificial Sequence: Synthetic oligonucleotide"
  source: /note="CF W1282X nAPG09882 Target 4"
cagtgaaggaaagcctttggagtga

SEQ ID NO: 329 - DNA, 25 bp, Artificial Sequence
  source: /note="Description of Artificial Sequence: Synthetic oligonucleotide"
  source: /note="CF W1282X nAPG09882 Target 5"
gtgaaggaaagcctttggagtgata

SEQ ID NO: 330 - DNA, 25 bp, Artificial Sequence
  source: /note="Description of Artificial Sequence: Synthetic oligonucleotide"
  source: /note="CF W1282X nAPG06646 Target 1"
tcaataactttgcaacagtgaagga

SEQ ID NO: 331 - DNA, 25 bp, Artificial Sequence
  source: /note="Description of Artificial Sequence: Synthetic oligonucleotide"
  source: /note="CF W1282X nAPG06646 Target 2"
aacagtgaaggaaagcctttggagt

SEQ ID NO: 332 - DNA, 25 bp, Artificial Sequence
  source: /note="Description of Artificial Sequence: Synthetic oligonucleotide"
  source: /note="CF W1282X nAPG06646 Target 3"
acagtgaaggaaagcctttggagtg

SEQ ID NO: 333 - DNA, 25 bp, Artificial Sequence
  source: /note="Description of Artificial Sequence: Synthetic oligonucleotide"
  source: /note="CF W1282X nAPG06646 Target 4"
agtgaaggaaagcctttggagtgat

SEQ ID NO: 334 - DNA, 20 bp, Artificial Sequence
  source: /note="Description of Artificial Sequence: Synthetic oligonucleotide"
  source: /note="CF W1282X nAPG03850 Target 1"
ttgcaacagtgaaggaaagc

SEQ ID NO: 335 - DNA, 20 bp, Artificial Sequence
  source: /note="Description of Artificial Sequence: Synthetic oligonucleotide"
  source: /note="CF W1282X nAPG03850 Target 2"
tgcaacagtgaaggaaagcc

SEQ ID NO: 336 - DNA, 20 bp, Artificial Sequence
  source: /note="Description of Artificial Sequence: Synthetic oligonucleotide"
  source: /note="CF W1282X nAPG03850 Target 3"
caacagtgaaggaaagcctt

SEQ ID NO: 337 - DNA, 20 bp, Artificial Sequence
  source: /note="Description of Artificial Sequence: Synthetic oligonucleotide"
  source: /note="CF W1282X nAPG03850 Target 4"
acagtgaaggaaagcctttg

SEQ ID NO: 338 - DNA, 20 bp, Artificial Sequence
  source: /note="Description of Artificial Sequence: Synthetic oligonucleotide"
  source: /note="CF W1282X nAPG07553 Target 1"
caacagtgaaggaaagcctt

SEQ ID NO: 339 - DNA, 20 bp, Artificial Sequence
  source: /note="Description of Artificial Sequence: Synthetic oligonucleotide"
  source: /note="CF W1282X nAPG07553 Target 2"
acagtgaaggaaagcctttg

SEQ ID NO: 340 - DNA, 20 bp, Artificial Sequence
  source: /note="Description of Artificial Sequence: Synthetic oligonucleotide"
  source: /note="CF W1282X nAPG01604 Target 1"
gcaacagtgaaggaaagcct

SEQ ID NO: 341 - DNA, 20 bp, Artificial Sequence
  source: /note="Description of Artificial Sequence: Synthetic oligonucleotide"
  source: /note="CF W1282X nAPG01604 Target 2"
caacagtgaaggaaagcctt

SEQ ID NO: 342 - DNA, 25 bp, Artificial Sequence
  source: /note="Description of Artificial Sequence: Synthetic oligonucleotide"
  source: /note="CF W1282X nAPG07433.1 Target 1"
aacagtgaaggaaagcctttggagt

SEQ ID NO: 343 - DNA, 20 bp, Artificial Sequence
  source: /note="Description of Artificial Sequence: Synthetic oligonucleotide"
  source: /note="CF W1282X nAPG09748 Target 1"
cttcactgttgcaaagttat

SEQ ID NO: 344 - DNA, 20 bp, Artificial Sequence
  source: /note="Description of Artificial Sequence: Synthetic oligonucleotide"
  source: /note="CF W1282X nAPG05586 Target 1"
gtgaaggaaagcctttggag

SEQ ID NO: 345 - RNA, 118 nt, Artificial Sequence
  source: /note="Description of Artificial Sequence: Synthetic polynucleotide"
  source: /note="CF W1282X nAPG09882 Target 1 sgRNA"
acuuugcaacagugaaggaaagccuguuuuuguacucucaauaaaaaguuauugagaaucuacaaaaauaaggcauuuugccgaauuuaccgcccuacauauguagggcgguuuuuuu

SEQ ID NO: 346 - RNA, 118 nt, Artificial Sequence
  source: /note="Description of Artificial Sequence: Synthetic polynucleotide"
  source: /note="CF W1282X nAPG09882 Target 2 sgRNA"
ugcaacagugaaggaaagccuuuggguuuuuguacucucaauaaaaaguuauugagaaucuacaaaaauaaggcauuuugccgaauuuaccgcccuacauauguagggcgguuuuuuu

SEQ ID NO: 347 - RNA, 118 nt, Artificial Sequence
  source: /note="Description of Artificial Sequence: Synthetic polynucleotide"
  source: /note="CF W1282X nAPG09882 Target 3 sgRNA"
caacagugaaggaaagccuuuggagguuuuuguacucucaauaaaaaguuauugagaaucuacaaaaauaaggcauuuugccgaauuuaccgcccuacauauguagggcgguuuuuuu

SEQ ID NO: 348 - RNA, 118 nt, Artificial Sequence
  source: /note="Description of Artificial Sequence: Synthetic polynucleotide"
  source: /note="CF W1282X nAPG09882 Target 4 sgRNA"
cagugaaggaaagccuuuggagugaguuuuuguacucucaauaaaaaguuauugagaaucuacaaaaauaaggcauuuugccgaauuuaccgcccuacauauguagggcgguuuuuuu

SEQ ID NO: 349 - RNA, 118 nt, Artificial Sequence
  source: /note="Description of Artificial Sequence: Synthetic polynucleotide"
  source: /note="CF W1282X nAPG09882 Target 5 sgRNA"
gugaaggaaagccuuuggagugauaguuuuuguacucucaauaaaaaguuauugagaaucuacaaaaauaaggcauuuugccgaauuuaccgcccuacauauguagggcgguuuuuuu

SEQ ID NO: 350 - RNA, 164 nt, Artificial Sequence
  source: /note="Description of Artificial Sequence: Synthetic polynucleotide"
  source: /note="CF W1282X nAPG06646 Target 1 sgRNA"
ucaauaacuuugcaacagugaaggagccauaauuccucuguaaaacuuaaagaagguuuauagaguuauuaugguaaggcaauaugccguggcguuggggaucgccuauguccgguuuuaccggaucucccuaaaggugacuaacuuugguuagucaccuuuuu

SEQ ID NO: 351 - RNA, 164 nt, Artificial Sequence
  source: /note="Description of Artificial Sequence: Synthetic polynucleotide"
  source: /note="CF W1282X nAPG06646 Target 2 sgRNA"
aacagugaaggaaagccuuuggagugccauaauuccucuguaaaacuuaaagaagguuuauagaguuauuaugguaaggcaauaugccguggcguuggggaucgccuauguccgguuuuaccggaucucccuaaaggugacuaacuuugguuagucaccuuuuu

SEQ ID NO: 352 - RNA, 164 nt, Artificial Sequence
  source: /note="Description of Artificial Sequence: Synthetic polynucleotide"
  source: /note="CF W1282X nAPG06646 Target 3 sgRNA"
acagugaaggaaagccuuuggaguggccauaauuccucuguaaaacuuaaagaagguuuauagaguuauuaugguaaggcaauaugccguggcguuggggaucgccuauguccgguuuuaccggaucucccuaaaggugacuaacuuugguuagucaccuuuuu

SEQ ID NO: 353 - RNA, 164 nt, Artificial Sequence
  source: /note="Description of Artificial Sequence: Synthetic polynucleotide"
  source: /note="CF W1282X nAPG06646 Target 4 sgRNA"
agugaaggaaagccuuuggagugaugccauaauuccucuguaaaacuuaaagaagguuuauagaguuauuaugguaaggcaauaugccguggcguuggggaucgccuauguccgguuuuaccggaucucccuaaaggugacuaacuuugguuagucaccuuuuu

SEQ ID NO: 354 - RNA, 163 nt, Artificial Sequence
  source: /note="Description of Artificial Sequence: Synthetic polynucleotide"
  source: /note="CF W1282X nAPG03850 Target 1 sgRNA"
uugcaacagugaaggaaagcgcuauaguuccauaagaaaaaaguuucuuaaguuacuauaguaagggcaaugacccguggcguuuggggaucgccuuauccugguauggauauucuccccaugugaaaagcaccuaagcauagcgcuauggugcuuuuauuuu

SEQ ID NO: 355 - RNA, 163 nt, Artificial Sequence
  source: /note="Description of Artificial Sequence: Synthetic polynucleotide"
  source: /note="CF W1282X nAPG03850 Target 2 sgRNA"
ugcaacagugaaggaaagccgcuauaguuccauaagaaaaaaguuucuuaaguuacuauaguaagggcaaugacccguggcguuuggggaucgccuuauccugguauggauauucuccccaugugaaaagcaccuaagcauagcgcuauggugcuuuuauuuu

SEQ ID NO: 356 - RNA, 163 nt, Artificial Sequence
  source: /note="Description of Artificial Sequence: Synthetic polynucleotide"
  source: /note="CF W1282X nAPG03850 Target 3 sgRNA"
caacagugaaggaaagccuugcuauaguuccauaagaaaaaaguuucuuaaguuacuauaguaagggcaaugacccguggcguuuggggaucgccuuauccugguauggauauucuccccaugugaaaagcaccuaagcauagcgcuauggugcuuuuauuuu

SEQ ID NO: 357 - RNA, 163 nt, Artificial Sequence
  source: /note="Description of Artificial Sequence: Synthetic polynucleotide"
  source: /note="CF W1282X nAPG03850 Target 4 sgRNA"
acagugaaggaaagccuuuggcuauaguuccauaagaaaaaaguuucuuaaguuacuauaguaagggcaaugacccguggcguuuggggaucgccuuauccugguauggauauucuccccaugugaaaagcaccuaagcauagcgcuauggugcuuuuauuuu

SEQ ID NO: 358 - RNA, 151 nt, Artificial Sequence
  source: /note="Description of Artificial Sequence: Synthetic polynucleotide"
  source: /note="CF W1282X nAPG07553 Target 1 sgRNA"
caacagugaaggaaagccuugcuauaguuccauaagaaagcuuaaguuacuauaguaagggcaaugacccguggcguuuggggaucgccucauccauuacggauauucuccccaugugaaaagcaccuaagcauaaggcuaaggugcuuuu

SEQ ID NO: 359 - RNA, 151 nt, Artificial Sequence
  source: /note="Description of Artificial Sequence: Synthetic polynucleotide"
  source: /note="CF W1282X nAPG07553 Target 2 sgRNA"
acagugaaggaaagccuuuggcuauaguuccauaagaaagcuuaaguuacuauaguaagggcaaugacccguggcguuuggggaucgccucauccauuacggauauucuccccaugugaaaagcaccuaagcauaaggcuaaggugcuuuu

SEQ ID NO: 360 - RNA, 105 nt, Artificial Sequence
  source: /note="Description of Artificial Sequence: Synthetic polynucleotide"
  source: /note="CF W1282X nAPG01604 Target 1 sgRNA"
gcaacagugaaggaaagccuguuuuaguacucuguaaaaaguuacagaaucuacuaaaacaaggcaaaaugccguguuuaucucgucaacuuguuggcgagauuu

SEQ ID NO: 361 - RNA, 105 nt, Artificial Sequence
  source: /note="Description of Artificial Sequence: Synthetic polynucleotide"
  source: /note="CF W1282X nAPG01604 Target 2 sgRNA"
caacagugaaggaaagccuuguuuuaguacucuguaaaaaguuacagaaucuacuaaaacaaggcaaaaugccguguuuaucucgucaacuuguuggcgagauuu

SEQ ID NO: 362 - RNA, 135 nt, Artificial Sequence
  source: /note="Description of Artificial Sequence: Synthetic polynucleotide"
  source: /note="CF W1282X nAPG07433.1 Target 1 sgRNA"
aacagugaaggaaagccuuuggagugucauaguuccauuaaagccaaaaguggcuuugauguuucuaugauaaggguuucgacccguggcgucggggaucgccugcccauugaaaugggcuucuccccauuuauu

SEQ ID NO: 363 - RNA, 135 nt, Artificial Sequence
  source: /note="Description of Artificial Sequence: Synthetic polynucleotide"
  source: /note="CF W1282X nAPG09748 Target 1 sgRNA"
cgacgguuagaggccguaugucgauuugcuuuaauuucgugcgugugcauugucguccuccauuacagggcggcuaccacgaauagccacgaaguaaaagcuucguggcuagcaccuucacuguugcaaaguuau

SEQ ID NO: 364 - RNA, 110 nt, Artificial Sequence
  source: /note="Description of Artificial Sequence: Synthetic polynucleotide"
  source: /note="CF W1282X nAPG05586 Target 1 sgRNA"
gugaaggaaagccuuuggagguuauuguacucucaauaaaaaguuauugagaaucuacaauaauaaggcaucuugccgaauuuaccgcccuacauauguagggcgguuuu

SEQ ID NO: 365 - protein, 8 aa, Artificial Sequence
  source: /note="Description of Artificial Sequence: Synthetic peptide"
  source: /note="APG07433.1 deleted motif"
LKKERNGA

SEQ ID NO: 366 - protein, 1063 aa, Artificial Sequence
  source: /note="Description of Artificial Sequence: Synthetic polypeptide"
  source: /note="APG07433.1 engineered deletion"
MRELDYRIGLDIGTNSIGWGVIELSWNKDRERYEKVRIVDQGVRMFDRAEMPKTGASLAEPRRIARSSRRRLNRKSQRKKNIRNLLVQHGVITQEELDSLYPLSKKSMDIWGIRLDGLDRLLNHFEWARLLIHLAQRRGFKSNRKSELKDTETGKVLSSIQLNEKRLSLYRTVGEMWMKDPDFSKYDRKRNSPNEYVFSVSRAELEKEIVTLFAAQRRFQSPYASKDLQETYLQIWTHQLPFASGNAILNKVGYCSLLKGKERRIPKATYTFQYFSALDQVNRTRLGPDFQPFTKEQREIILNNMFQRTDYYKKKTIPEVTYYDIRKWLELDETIQFKGLNYDPNEELKKIEKKPFINLKAFYEINKVVANYSERTNETFSTLDYDGIGYALTVYKTDKDIRSYLKSSHNLPKRCYDDQLIEELLSLSYTKFGHLSLKAINHVLSIMQKGNTYKEAVDQLGYDTSGLKKEKRSKFLPPISDEITNPIVKRALTQARKVVNAIIRRHGSPHSVHIELARELSKNHDERTKIVSAQDENYKKNKGAISILSEHGILNPTGYDIVRYKLWKEQGERCAYSLKEIPADTFFNEPILEVDHILPYSQSFIDSYHNKVLVYSDENRKKGNRIPYTYFLETNKDWEAFERYVRSNKFFSKKKREYLLKRAYLPRESELIKERHLNDTRYASTFLKNFIEQNLQFKEAEDNPRKRRVQTVNGVITAHFRKRWGLEKDRQETYLHHAMDAIIVACTDHHMVTRVTEYYQIKESNKSVKKPYFPMPWEGFRDELLSHLASQPIAKKISEELKAGYQSLDYIFVSRMPKRSITGAAHKQTIMRKGGIDKKGKTIIIERLHLKDIKFDENGDFKMVGKEQDMATYEAIKQRYLEHGKNSKKAFETPLYKPSKKGTGNLIKRVKVEGQAKSFVREVNGGVAQNGDLVRVDLFEKDDKYYMVPIYVPDTVCSELPKKVVASSKGYEQWLTLDNSFTFKFSLYPYDLVRLVKGDEDRFLYFGTLDIDSDRLNFKDVNKPSKKNEYRYSLKTIEDLEKYEVGVLGDLRLVRKETRRNFH

SEQ ID NO: 367 - protein, 8 aa, Artificial Sequence
  source: /note="Description of Artificial Sequence: Synthetic peptide"
  source: /note="APG08290.1 deleted motif"
LKKERNGS

SEQ ID NO: 368 - protein, 1064 aa, Artificial Sequence
  source: /note="Description of Artificial Sequence: Synthetic polypeptide"
  source: /note="APG08290.1 engineered deletion"
MSELDYRIGLDIGTNSIGWGVIELFWNKDRERYEKVRIVDKGVRMFDKAEIPNKGASLAEPRRIARSSRRRLNRKSQRKKEIRNLLVQHGMITQEELDLLYPLSKKSIDIWDIRLDGLDRLLNHLEWARLLIHLAQRRGFKSNRKSELKDAETGKVLSSIQVNEKRLFLYRTVGEMWIKDAEFSKYDRRRNSPNEYVFSVSRADLEKEIVTLFEAQRKFQSSYASKNLQETYLQIWAHQLPFASGNAILNKVGYCSLLKGKERRIPKATYTFQYFSALDQVNRTRLGPDFQPFTQEQKEIILDKMFQRTDYYKKKTIPEVSYYDIRKWLELDETIQFKGLNYDPNEELKKIEKKPFINLKAFYEIKKVVANYAERTNEAFSTLDYDAIAYALTVYKTDKDIRSYLKKSNNLSKRCYDDQLIEELFTLSYTKFGHLSFKAINHVLPIMQEGRTYQEAIHQLGYDTTNLKKENRSMFLPLIPDEITNPIVKRAITQARKVVNAIIRRYGSPNSVHIELARELSKSHDERKKIMTAHDENYKKNKGAISILIENGILNPTGYDIVRYKLWKEQGERCAYSLKEIPPDTFFNEPILEVDHILPYSQSFIDSYHNKVLVYSDENRNKGNRIPYTYFLETNKDWEAFERYVRSNKLFSKKKREYLLKKTYLPRESELIKERHLNDTRYASTFLKNFIEQNLQFKEVEVNLRKKRVQTVNGVITAHLRKRWGLEKNRQETYLHHAMDAIIVACTDHHMVTRITEYYQIKESNKSVKKPYFPMPWEGFRDELLSHLASQPIAKKISEELKAGYQSSDYIFVSRMPKRSVTGAAHDQTIRRKGGIDKKGKTIIIKRVRLKDIKFDENGDFKMVGKEQDLATYEAIKQRYLEHRKNSKKAFETPLYKPSKKGTGNLIKRVKIEGQTKAFVREVNGGVAQNSDLVRVDLFEKDDKYYMVPIYVPDTVCSELPKKVVKSGKGYEQWLTLDNSFTFKSSLYPYDLVRLVKGNEDRFLYFGTLDIDSDRLNFKDVNKPSKQNEYRYSLKTIENLEKYEVGVLGDLRLVKQETRRIFNR

SEQ ID NO: 369 - DNA, 20 bp, Artificial Sequence
  source: /note="Description of Artificial Sequence: Synthetic oligonucleotide"
  source: /note="SGN000139 target sequence"
aggttttaatggcccagcct

SEQ ID NO: 370 - DNA, 20 bp, Artificial Sequence
  source: /note="Description of Artificial Sequence: Synthetic oligonucleotide"
  source: /note="SGN000143 target sequence"
catggcagtacattagagca

SEQ ID NO: 371 - DNA, 20 bp, Artificial Sequence
  source: /note="Description of Artificial Sequence: Synthetic oligonucleotide"
  source: /note="SGN000169 target sequence"
cacatctcgagcaagacgtt

SEQ ID NO: 372 - DNA, 20 bp, Artificial Sequence
  source: /note="Description of Artificial Sequence: Synthetic oligonucleotide"
  source: /note="SGN000173 target sequence"
cttctatagcctccttcccc

SEQ ID NO: 373 - DNA, 20 bp, Artificial Sequence
  source: /note="Description of Artificial Sequence: Synthetic oligonucleotide"
  source: /note="SGN000186 target sequence"
ggacagtgcgcatctccctg

SEQ ID NO: 374 - DNA, 20 bp, Artificial Sequence
  source: /note="Description of Artificial Sequence: Synthetic oligonucleotide"
  source: /note="SGN000194 target sequence"
gccgcacagcattcaggtcg

SEQ ID NO: 375 - DNA, 25 bp, Artificial Sequence
  source: /note="Description of Artificial Sequence: Synthetic oligonucleotide"
  source: /note="SGN000926 target sequence"
agagccatcaccatcacatccctaa

SEQ ID NO: 376 - DNA, 25 bp, Artificial Sequence
  source: /note="Description of Artificial Sequence: Synthetic oligonucleotide"
  source: /note="SGN000927 target sequence"
ggccaaaatccagctgccttccttg

SEQ ID NO: 377 - DNA, 25 bp, Artificial Sequence
  source: /note="Description of Artificial Sequence: Synthetic oligonucleotide"
  source: /note="SGN000928 target sequence"
gcttctactcttggcttacaaccca

SEQ ID NO: 378 - DNA, 25 bp, Artificial Sequence
  source: /note="Description of Artificial Sequence: Synthetic oligonucleotide"
  source: /note="SGN000929 target sequence"
atctggagggaacttacagcatatg

SEQ ID NO: 379 - DNA, 25 bp, Artificial Sequence
  source: /note="Description of Artificial Sequence: Synthetic oligonucleotide"
  source: /note="SGN000930 target sequence"
gaacaactcaaatggaaatgaatat

SEQ ID NO: 380 - DNA, 25 bp, Artificial Sequence
  source: /note="Description of Artificial Sequence: Synthetic oligonucleotide"
  source: /note="SGN000931 target sequence"
tcctgttccatcaccatcaaaaaaa

SEQ ID NO: 381 - DNA, 25 bp, Artificial Sequence
  source: /note="Description of Artificial Sequence: Synthetic oligonucleotide"
  source: /note="SGN000935 target sequence"
tgttggttacctccctgccaccacc

SEQ ID NO: 382 - DNA, 25 bp, Artificial Sequence
  source: /note="Description of Artificial Sequence: Synthetic oligonucleotide"
  source: /note="SGN001101 target sequence"
atattttctttaatggtgccaggca

SEQ ID NO: 383 - RNA, 130 nt, Artificial Sequence; identical to SEQ ID NO: 30
  source: /note="Description of Artificial Sequence: Synthetic polynucleotide"
  source: /note="SGN000139 sgRNA"

SEQ ID NO: 384 - RNA, 130 nt, Artificial Sequence; identical to SEQ ID NO: 29
  source: /note="Description of Artificial Sequence: Synthetic polynucleotide"
  source: /note="SGN000143 sgRNA"

SEQ ID NO: 385 - RNA, 130 nt, Artificial Sequence
  source: /note="Description of Artificial Sequence: Synthetic polynucleotide"
  source: /note="SGN000169 sgRNA"
cacaucucgagcaagacguugucauaguuccauuaaagccaaaaguggcuuugauguuucuaugauaaggguuucgacccguggcgucggggaucgccugcccauugaaaugggcuucuccccauuuauu

SEQ ID NO: 386 - RNA, 130 nt, Artificial Sequence
  source: /note="Description of Artificial Sequence: Synthetic polynucleotide"
  source: /note="SGN000173 sgRNA"
cuucuauagccuccuuccccgucauaguuccauuaaagccaaaaguggcuuugauguuucuaugauaaggguuucgacccguggcgucggggaucgccugcccauugaaaugggcuucuccccauuuauu

SEQ ID NO: 387 - RNA, 130 nt, Artificial Sequence; identical to SEQ ID NO: 27
  source: /note="Description of Artificial Sequence: Synthetic polynucleotide"
  source: /note="SGN000186 sgRNA"

SEQ ID NO: 388 - RNA, 130 nt, Artificial Sequence; identical to SEQ ID NO: 28
  source: /note="Description of Artificial Sequence: Synthetic polynucleotide"
  source: /note="SGN000194 sgRNA"

SEQ ID NO: 389 - RNA, 135 nt, Artificial Sequence
  source: /note="Description of Artificial Sequence: Synthetic polynucleotide"
  source: /note="SGN000926 sgRNA"
agagccaucaccaucacaucccuaagucauaguuccaugaaagccaaaaguggcuuugauguuucuaugauaaggguuucggcccguggcgucggggaucgccugcccauuccgaugggcuucuccccauuuauu

SEQ ID NO: 390 - RNA, 135 nt, Artificial Sequence
  source: /note="Description of Artificial Sequence: Synthetic polynucleotide"
  source: /note="SGN000927 sgRNA"
ggccaaaauccagcugccuuccuuggucauaguuccaugaaagccaaaaguggcuuugauguuucuaugauaaggguuucggcccguggcgucggggaucgccugcccauuccgaugggcuucuccccauuuauu

SEQ ID NO: 391 - RNA, 135 nt, Artificial Sequence
  source: /note="Description of Artificial Sequence: Synthetic polynucleotide"
  source: /note="SGN000928 sgRNA"
gcuucuacucuuggcuuacaacccagucauaguuccaugaaagccaaaaguggcuuugauguuucuaugauaaggguuucggcccguggcgucggggaucgccugcccauuccgaugggcuucuccccauuuauu

SEQ ID NO: 392 - RNA, 135 nt, Artificial Sequence
  source: /note="Description of Artificial Sequence: Synthetic polynucleotide"
  source: /note="SGN000929 sgRNA"
aucuggagggaacuuacagcauauggucauaguuccaugaaagccaaaaguggcuuugauguuucuaugauaaggguuucggcccguggcgucggggaucgccugcccauuccgaugggcuucuccccauuuauu

SEQ ID NO: 393 - RNA, 135 nt, Artificial Sequence; identical to SEQ ID NO: 26
  source: /note="Description of Artificial Sequence: Synthetic polynucleotide"
  source: /note="SGN000930 sgRNA"

SEQ ID NO: 394 - RNA, 135 nt, Artificial Sequence
  source: /note="Description of Artificial Sequence: Synthetic polynucleotide"
  source: /note="SGN000931 sgRNA"
uccuguuccaucaccaucaaaaaaagucauaguuccaugaaagccaaaaguggcuuugauguuucuaugauaaggguuucggcccguggcgucggggaucgccugcccauuccgaugggcuucuccccauuuauu

SEQ ID NO: 395 - RNA, 135 nt, Artificial Sequence
  source: /note="Description of Artificial Sequence: Synthetic polynucleotide"
  source: /note="SGN000935 sgRNA"
uguugguuaccucccugccaccaccgucauaguuccaugaaagccaaaaguggcuuugauguuucuaugauaaggguuucggcccguggcgucggggaucgccugcccauuccgaugggcuucuccccauuuauu

SEQ ID NO: 396 - RNA, 130 nt, Artificial Sequence
  source: /note="Description of Artificial Sequence: Synthetic polynucleotide"
  source: /note="SGN001101 sgRNA"
auauuuucuuuaauggugccaggcagucauaguuccauuaaagccaaaaguggcuuugauguuucuaugauaaggguuucgacccguggcgucggggaucgccugcccauugaaaugggcuucuccccau

SEQ ID NO: 397 - protein, 1063 aa, Artificial Sequence
  source: /note="Description of Artificial Sequence: Synthetic polypeptide"
  source: /note="nAPG07433.1-del"
MRELDYRIGLAIGTNSIGWGVIELSWNKDRERYEKVRIVDQGVRMFDRAEMPKTGASLAEPRRIARSSRRRLNRKSQRKKNIRNLLVQHGVITQEELDSLYPLSKKSMDIWGIRLDGLDRLLNHFEWARLLIHLAQRRGFKSNRKSELKDTETGKVLSSIQLNEKRLSLYRTVGEMWMKDPDFSKYDRKRNSPNEYVFSVSRAELEKEIVTLFAAQRRFQSPYASKDLQETYLQIWTHQLPFASGNAILNKVGYCSLLKGKERRIPKATYTFQYFSALDQVNRTRLGPDFQPFTKEQREIILNNMFQRTDYYKKKTIPEVTYYDIRKWLELDETIQFKGLNYDPNEELKKIEKKPFINLKAFYEINKVVANYSERTNETFSTLDYDGIGYALTVYKTDKDIRSYLKSSHNLPKRCYDDQLIEELLSLSYTKFGHLSLKAINHVLSIMQKGNTYKEAVDQLGYDTSGLKKEKRSKFLPPISDEITNPIVKRALTQARKVVNAIIRRHGSPHSVHIELARELSKNHDERTKIVSAQDENYKKNKGAISILSEHGILNPTGYDIVRYKLWKEQGERCAYSLKEIPADTFFNEPILEVDHILPYSQSFIDSYHNKVLVYSDENRKKGNRIPYTYFLETNKDWEAFERYVRSNKFFSKKKREYLLKRAYLPRESELIKERHLNDTRYASTFLKNFIEQNLQFKEAEDNPRKRRVQTVNGVITAHFRKRWGLEKDRQETYLHHAMDAIIVACTDHHMVTRVTEYYQIKESNKSVKKPYFPMPWEGFRDELLSHLASQPIAKKISEELKAGYQSLDYIFVSRMPKRSITGAAHKQTIMRKGGIDKKGKTIIIERLHLKDIKFDENGDFKMVGKEQDMATYEAIKQRYLEHGKNSKKAFETPLYKPSKKGTGNLIKRVKVEGQAKSFVREVNGGVAQNGDLVRVDLFEKDDKYYMVPIYVPDTVCSELPKKVVASSKGYEQWLTLDNSFTFKFSLYPYDLVRLVKGDEDRFLYFGTLDIDSDRLNFKDVNKPSKKNEYRYSLKTIEDLEKYEVGVLGDLRLVRKETRRNFH

SEQ ID NO: 398 - protein, 1064 aa, Artificial Sequence
  source: /note="Description of Artificial Sequence: Synthetic polypeptide"
  source: /note="nAPG08290.1-del"
MSELDYRIGLAIGTNSIGWGVIELFWNKDRERYEKVRIVDKGVRMFDKAEIPNKGASLAEPRRIARSSRRRLNRKSQRKKEIRNLLVQHGMITQEELDLLYPLSKKSIDIWDIRLDGLDRLLNHLEWARLLIHLAQRRGFKSNRKSELKDAETGKVLSSIQVNEKRLFLYRTVGEMWIKDAEFSKYDRRRNSPNEYVFSVSRADLEKEIVTLFEAQRKFQSSYASKNLQETYLQIWAHQLPFASGNAILNKVGYCSLLKGKERRIPKATYTFQYFSALDQVNRTRLGPDFQPFTQEQKEIILDKMFQRTDYYKKKTIPEVSYYDIRKWLELDETIQFKGLNYDPNEELKKIEKKPFINLKAFYEIKKVVANYAERTNEAFSTLDYDAIAYALTVYKTDKDIRSYLKKSNNLSKRCYDDQLIEELFTLSYTKFGHLSFKAINHVLPIMQEGRTYQEAIHQLGYDTTNLKKENRSMFLPLIPDEITNPIVKRAITQARKVVNAIIRRYGSPNSVHIELARELSKSHDERKKIMTAHDENYKKNKGAISILIENGILNPTGYDIVRYKLWKEQGERCAYSLKEIPPDTFFNEPILEVDHILPYSQSFIDSYHNKVLVYSDENRNKGNRIPYTYFLETNKDWEAFERYVRSNKLFSKKKREYLLKKTYLPRESELIKERHLNDTRYASTFLKNFIEQNLQFKEVEVNLRKKRVQTVNGVITAHLRKRWGLEKNRQETYLHHAMDAIIVACTDHHMVTRITEYYQIKESNKSVKKPYFPMPWEGFRDELLSHLASQPIAKKISEELKAGYQSSDYIFVSRMPKRSVTGAAHDQTIRRKGGIDKKGKTIIIKRVRLKDIKFDENGDFKMVGKEQDLATYEAIKQRYLEHRKNSKKAFETPLYKPSKKGTGNLIKRVKIEGQTKAFVREVNGGVAQNSDLVRVDLFEKDDKYYMVPIYVPDTVCSELPKKVVKSGKGYEQWLTLDNSFTFKSSLYPYDLVRLVKGNEDRFLYFGTLDIDSDRLNFKDVNKPSKQNEYRYSLKTIENLEKYEVGVLGDLRLVKQETRRIFNR

SEQ ID NO: 399 - protein, 169 aa, Artificial Sequence
  source: /note="Description of Artificial Sequence: Synthetic polypeptide"
  source: /note="LPG50140 protein sequence"
MSDLELNHEYWMRHALQLAKRARDEGEVPVGAVLVLNNQVIGEGWNRAIGLHDPTAHAEIMALRQGGLVLQNYRLIDTTLYVTFEPCVMCSGAMVHSRIGTLVFGVRNSKRGAAGSLMNVLNYPGMNHQVQIIDGVLAPECSGLLCDFYRMPRQVFNQQKAESTSINGD

SEQ ID NO: 400 - protein, 164 aa, Artificial Sequence
  source: /note="Description of Artificial Sequence: Synthetic polypeptide"
  source: /note="LPG50141 protein sequence"
MSNPELTHEHWMRYALTLAKRAREEGEVPVGAVLVLNNQVIGEGWNRAIGLHDPTAHAEIMALRQGGLVLQNYRLIDTTLYVTFEPCVMCAGAMVHSRIGQLVFGVRNSKRGAAGSLMNVLNYPGMNHRIEFTEGVLRDECAAMLCDFYRQPRQVFNALKTGNA

SEQ ID NO: 401 - protein, 169 aa, Artificial Sequence
  source: /note="Description of Artificial Sequence: Synthetic polypeptide"
  source: /note="LPG50142 protein sequence"
MSIPELNHDVWMRHALTLAKRAREEGEVPVGAVLVLNGQVIGEGWNRAIGLHDPTAHAEIMALRQGGLVLQNYRLIDTTLYVTFEPCVMCAGAMVHSRIGQLVFGVRNSKRGAAGSLINVLNYPGMNHRVAITEGVLREECAAMLCDFYRQPRQVFNALKKPAGDINAF

SEQ ID NO: 402 - protein, 172 aa, Artificial Sequence
  source: /note="Description of Artificial Sequence: Synthetic polypeptide"
  source: /note="LPG50143 protein sequence"
MSNPELNHEYWMRYALTLAKRARDEGEVPVGAVLVLNDQVIGEGWNRAIGLHDPTAHAEIMALRQGGLVLQNYRLIDTTLYVTFEPCVMCAGAMVHSRIGRLVFGVRNSKRGAAGSLLNVLNYPGMNHHIEMEEGVLRDECAAMLCDFYRQPRQVFNALKKSPPDINNLQAR

SEQ ID NO: 403 - protein, 169 aa, Artificial Sequence
  source: /note="Description of Artificial Sequence: Synthetic polypeptide"
  source: /note="LPG50144 protein sequence"
MSNPELTHDHWMRHALTLAQRARNEGEVPVGAVLVLNGQVIGEGWNRAIGLHDPTAHAEIMALRQGGLVLQNYRLIDTVLYVTFEPCVMCAGAMVHSRIGQLVFGVRNSKRGAAGSLINVLNYPGMNHRVEIIEGVLRDECAAMLCDFYRHPRQVFNALKKNAGTINTQ

SEQ ID NO: 404 - protein, 166 aa, Artificial Sequence
  source: /note="Description of Artificial Sequence: Synthetic polypeptide"
  source: /note="LPG50145 protein sequence"
MSDTELNHEYWMRHALMLAKRARDEGEVPVGAVLVLKNQVIGEGWNRAIGLHDPTAHAEIMALRQGGLVLQNYRLIDTTLYVTFEPCVMCAGAMVHSRIGNLVFGVRNSKRGAAGSLINVLNYPGMNHRVEIAEGVLADECSAMLCDFYRHPRQVFNALKQAAKHI

SEQ ID NO: 405 - protein, 171 aa, Artificial Sequence
  source: /note="Description of Artificial Sequence: Synthetic polypeptide"
  source: /note="LPG50146 protein sequence"
MSDIELNHEYWMRHALMLAKRAREEGEVPVGAVLVLNNQVIGEGWNRAIGLHDPTAHAEIMALRQGGLVLQNYRLIDTTLYVTFEPCVMCAGAMVHSRIGHLVFGVRNSKRGAAGSLINVLNYPGMNHRIEFTEGVLADECSGMLCDFYRYPRQVFNTLKQAAKAINPAAQ

SEQ ID NO: 406 - protein, 173 aa, Artificial Sequence
  source: /note="Description of Artificial Sequence: Synthetic polypeptide"
  source: /note="LPG50147 protein sequence"
MSIPELNHDVWMRHALTLAKRAREEGEVPVGAVLVLNGQVIGEGWNRAIGLHDPTAHAEIMALRQGGLVLQNYRLIDTTLYVTFEPCVMCAGAMVHSRIGQLVFGVRNSKRGAAGSLMNVLNYPGMNHRVEITEGVLRDECAAMLCDFYRQPRQVFNALKKPAGDINALQNNR

SEQ ID NO: 407 - protein, 168 aa, Artificial Sequence
  source: /note="Description of Artificial Sequence: Synthetic polypeptide"
  source: /note="LPG50148 protein sequence"
MSNPEFTHEYWMRHALTLARRARDEGEVPVGAVLVLNNQVIGEGWNRAIGLHDPTAHAEIMALRQGGLVLQNYRLIDTTLYVTFEPCVMCSGAMVHSRIGTLVFGVRNSKRGAAGSLMNVLNYPGMNHQVKTIGGVLAPECSGLLCDFYRMPRQVFNQQKAELKSIND

SEQ ID NO: 408 - protein, 167 aa, Artificial Sequence
  source: /note="Description of Artificial Sequence: Synthetic polypeptide"
  source: /note="LPG50149 protein sequence"
MSDAELTHEYWMRHALTLAQRARDEGEVPVGAVLVLNNQVIGEGWNRAIGLHDPTAHAEIMALRQGGLVQQNYRLIDTTLYVTFEPCVMCAGAMVHSRIGRLIFGVRNSKRGAAGSLINVLNYPGMNHRVEVVEGILRDECAGMLCDFYRQPRQVFNALKKGATDIN

SEQ ID NO: 409 - protein, 167 aa, Artificial Sequence
  source: /note="Description of Artificial Sequence: Synthetic polypeptide"
  source: /note="LPG50150 protein sequence"
MSDAELTHEYWMRHALTLAQRARDEGEVPVGAVLVLNNQVIGEGWNRAIGLHDPTAHAEIMALRQGGLVQQNYRLLDTTLYVTFEPCVMCAGAMVHSRIGRLIFGVRNSKRGAAGSLINVLNYPGMNHRVEVVEGILRDECAGMLCAFYRQPRAVKNALKKGATDVL

SEQ ID NO: 410 - protein, 169 aa, Artificial Sequence
  source: /note="Description of Artificial Sequence: Synthetic polypeptide"
  source: /note="LPG50151 protein sequence"
MSDLELNHEYWMRHALQLAQRARDEGEVPVGAVLVYNNQVIGEGWNRAIGLHDPTAHAEIMALRQGGLVLQNYRLLDTTLYVTFEPCVMCSGAMVHSRIGTLVFGVRNEKRGAAGSLMNVLRYPGMNHQVQIIDGVLAPECSGLLCDFYRMPRQQKNQQKAESTSSPGD

SEQ ID NO: 411 - protein, 167 aa, Artificial Sequence
  source: /note="Description of Artificial Sequence: Synthetic polypeptide"
  source: /note="LPG50152 protein sequence"
MSDNELNHEYWMRHALGLAKRAREEGEVPVGAVLVLNNQVIGEGWNRAIGLHDPTAHAEIMALRQGGLVLQNYRLTDTTLYVTFEPCVMCAGAMVHSRIGTLVFGVRNSKRGAAGSLMNVLNYPGMNHRVEIVEGILSESCAAMLCDFYRQPRAVKNALKKAADPAA

SEQ ID NO: 412 - protein, 164 aa, Artificial Sequence
  source: /note="Description of Artificial Sequence: Synthetic polypeptide"
  source: /note="LPG50153 protein sequence"
MSDTEFTHEHWMRHALTLAQRARDEGEVPVGAVLVLNNQVIGEGWNRAIGLHDPTAHAEIMALRQGGLVLQNYRLLDTTLYVTFEPCVMCAGAMVHSRIGHLVFGVRNSKRGAIGSLMNVLGYPGMNHQVQVSEGVLATECSAMLCDFYRAPRLVKNALKEKAR

SEQ ID NO: 413 - protein, 171 aa, Artificial Sequence
  source: /note="Description of Artificial Sequence: Synthetic polypeptide"
  source: /note="LPG50154 protein sequence"
MSESEFTHEHWMRHALTLARRAREEGEVPVGAVLVLNNQVIGEGWNRAIGLHDPTAHAEIMALRQGGLVLQNYRLLDSTLYVTFEPCVMCAGAMVHGRIGNLVFGVRNSKRGAIGSLMNVVGYPGMNHQINVIEGVLAEECSAMLCDFYRAPRLVKNALKEKARNGNNPNK

SEQ ID NO: 414 - protein, 164 aa, Artificial Sequence
  source: /note="Description of Artificial Sequence: Synthetic polypeptide"
  source: /note="LPG50155 protein sequence"
MSNPELTHEHWMRYALTLAKRAREEGEVPVGAVLVLNNQVIGEGWNRAIGLHDPTAHAEIMALRQGGLVLQNYRLIDTTLYVTFEPCVMCAGAMVHSRIGQLVFGVRNSKRGAAGSLMNVLNYPGMNHRIEFTEGVLRDECAAMLCDFYRQPRLVKNALKTGNA

SEQ ID NO: 415 - protein, 166 aa, Artificial Sequence
  source: /note="Description of Artificial Sequence: Synthetic polypeptide"
  source: /note="LPG50156 protein sequence"
MSDPELNHEYWMRHALQLAKRAREEGEVPVGAVLVLNNQVIGEGWNRAIGLHDPTAHAEIMALRQGGLVLQNYRLLDTTLYVTFEPCVMCSGAMIHSRIGTVVFGVRNEKRGAAGSLLNVLRYPGMNHQVNVLGGVLAPACSEMLCEFYRMPRQQKNRQKAESKLS

SEQ ID NO: 416 - protein, 166 aa, Artificial Sequence
  source: /note="Description of Artificial Sequence: Synthetic polypeptide"
  source: /note="LPG50157 protein sequence"
MSDNELNHEHWMRHALTLAQRAREEGEVPVGAVLVLQNQVIGEGWNRAIGLHDPTAHAEIMALRQGGMVLQNYRLIDTTLYVTFEPCVMCAGAMVHSRIGQLVFGVRNSKRGAAGSLINVLNYPGMNHRVEITEGVLADDCSSMLCDFYRHPREQKNALKRAAHSN

SEQ ID NO: 417 - protein, 168 aa, Artificial Sequence
  source: /note="Description of Artificial Sequence: Synthetic polypeptide"
  source: /note="LPG50158 protein sequence"
MSNPEHNHEYWMRHALTLAQRARDEGEVPVGAVLVYNNQVIGEGWNRAIGLHDPTAHAEIMALRQGGLVLQNYRLLDTTLYVTFEPCVMCSGAMVHSRIGTLVFGVRNEKRGAAGSLMNVLGYPGMNHQVQTIGGVLAPECSGLLCDFYRMPRQQKNQQKAELNQPGD

SEQ ID NO: 418 - protein, 168 aa, Artificial Sequence
  source: /note="Description of Artificial Sequence: Synthetic polypeptide"
  source: /note="LPG50159 protein sequence"
MSDLELNHEYWMRHALSLAKRARDEGEVPVGAVLVLNNQVIGEGWNRAIGLHDPTAHAEIMALRQGGLVLQNYRLLDTTLYVTFEPCVMCSGAMVHSRIGTLVYGVRNEKRGAAGSLMNVLGYPGMNHQVQIIGGVLAPDCSGLLCDFYRMPRQQKNQQKAELKSSGD

SEQ ID NO: 419 - protein, 166 aa, Artificial Sequence
  source: /note="Description of Artificial Sequence: Synthetic polypeptide"
  source: /note="LPG50160 protein sequence"
MSDHEFNDEYWMRHALTLAKRAREEGEVPVGAVLVLNNQVIGEGWNRAIGLHDPTAHAEIMALRQGGLVLQNYRLIDATLYVTFEPCVMCAGAMVHSRISRLVFGVRNSKRGAAGSLINVLNYPGMNHRVEITEGILAESCSAMLCDFYRWPREVKNALKKARQEE

SEQ ID NO: 420 - protein, 166 aa, Artificial Sequence
  source: /note="Description of Artificial Sequence: Synthetic polypeptide"
  source: /note="LPG50161 protein sequence"
MSQTELTHEYWMRHALTLAQRARDEGEVPVGAVLVLNNQVIGEGWNRAIGLHDPTAHAEIMALRQGGLVLQNYRLLDTTLYVTFEPCVMCAGAMVHGRIGTLVFGVRNSKRGAVGSLMNITGYPGMNHQVQVIEGILATECSAMLCAFYRQPRLVKNALKEAAKTA

SEQ ID NO: 421 - protein, 167 aa, Artificial Sequence
  source: /note="Description of Artificial Sequence: Synthetic polypeptide"
  source: /note="LPG50162 protein sequence"
MSNPELNHDYWMRHALSLAKRAREEGEVPVGAVLVRNNEVIGEGWNRAIGLHDPTAHAEIMALRQGGMVLQNYRLIDTTLYVTFEPCVMCAGAMVHSRIGQLVFGVRNSKRGAAGSLMNVLNYPGMNHRVEIVEGVLRDECAGMLCDFYRQPRLVKNAQKKGAEPLI

SEQ ID NO: 422 - protein, 172 aa, Artificial Sequence
  source: /note="Description of Artificial Sequence: Synthetic polypeptide"
  source: /note="LPG50163 protein sequence"
MSNPELNHEYWMRYALTLAKRARDEGEVPVGAVLVYNDQVIGEGWNRAIGLHDPTAHAEIMALRQGGLVLQNYRLIDTTLYVTFEPCVMCAGAMVHSRIGRLVFGVRNSKRGAAGSLLNVLNYPGMNHHIEMEEGVLRDECAAMLCDFYRQPRMVKNALKKSPPDSPNLQAR

SEQ ID NO: 423 - protein, 168 aa, Artificial Sequence
  source: /note="Description of Artificial Sequence: Synthetic polypeptide"
  source: /note="LPG50164 protein sequence"
MSNPEFTHEYWMRHALTLARRARDEGEVPVGAVLVLNNQVIGEGWNRAIGLHDPTAHAEIMALRQGGLVLQNYRLLDTTLYVTFEPCVMCSGAMVHSRIGTLVFGVRNEKRGAAGSLMNVLGYPGMNHQVKTIGGVLAPECSGLLCDFYRMPRQQKNQQKAELKSSGD

SEQ ID NO: 424 - protein, 165 aa, Artificial Sequence
  source: /note="Description of Artificial Sequence: Synthetic polypeptide"
  source: /note="LPG50165 protein sequence"
MSDNEFNHEYWMRHALTLAQRARDEGEVPVGAVLVLDNQVIGEGWNRAIGLHDPTAHAEIMALRQGGMVLQNYRLINATLYVTFEPCVMCAGAMVHSRIGHVVFGVRNSKRGAAGSLMNVLNYPGMNHRVEVTEGVLREQCAGMLCDFYREPREQFNALRKAQKA

SEQ ID NO: 425 - protein, 170 aa, Artificial Sequence
  source: /note="Description of Artificial Sequence: Synthetic polypeptide"
  source: /note="LPG50166 protein sequence"
MSDNELNHEYWMRHALTLAQRARDEGEVPVGAVLVLNNQVIGEGWNRAIGLHDPTAHAEIMALRQGGMVLQNYRLIDATLYVTFEPCIMCAGAMVHSRIGQVVFGVRNSKRGAAGSLINILNYPGMNHRVDVTEGVLSERCANMLCDFYREPRLQFNAQRKAEKAGNAAA

SEQ ID NO: 426 - protein, 169 aa, Artificial Sequence
  source: /note="Description of Artificial Sequence: Synthetic polypeptide"
  source: /note="LPG50167 protein sequence"
MSNPELTHDHWMRHALTLAQRARNEGEVPVGAVLVLNGQVIGEGWNRAIGLHDPTAHAEIMALRQGGLVLQNYRLIDTVLYVTFEPCVMCAGAMVHSRIGQLVFGVRNSKRGAAGSLINVLNYPGMNHRVEIIEGVLRDECAAMLCDFYRHPRLVKNALKKNAGTSPTQ

SEQ ID NO: 427 - protein, 166 aa, Artificial Sequence
  source: /note="Description of Artificial Sequence: Synthetic polypeptide"
  source: /note="LPG50168 protein sequence"
MSDTELNHEYWMRHALMLAKRARDEGEVPVGAVLVLKNQVIGEGWNRAIGLHDPTAHAEIMALRQGGLVLQNYRLIDTTLYVTFEPCVMCAGAMVHSRIGNLVFGVRNSKRGAAGSLINVLNYPGMNHRVEIAEGVLADECSAMLCDFYRHPRQQQNALKQAAKHD

SEQ ID NO: 428 - protein, 171 aa, Artificial Sequence
  source: /note="Description of Artificial Sequence: Synthetic polypeptide"
  source: /note="LPG50169 protein sequence"
MSDIELNHEYWMRHALMLAKRAREEGEVPVGAVLVLNNQVIGEGWNRAIGLHDPTAHAEIMALRQGGLVLQNYRLIDTTLYVTFEPCVMCAGAMVHSRIGHLVFGVRNSKRGAAGSLINVLNYPGMNHRIEFTEGVLADECSGMLCDFYRYPRQQQNTLKQAAKANPPAAQ

SEQ ID NO: 429 - protein, 165 aa, Artificial Sequence
  source: /note="Description of Artificial Sequence: Synthetic polypeptide"
  source: /note="LPG50170 protein sequence"
MSDNELNHERWMRHALTLAQRARDEGEVPVGAVLVYQNQVIGEGWNRAIGLHDPTAHAEIMALRQGGLVLQNYRLIDTTLYVTFEPCVMCAGAMVHSRIGQLVFGVRNSKRGAAGSLINVLNYPGMNHRVAITEGVLAESCSAMLCDFYRHPREQKNALRRAAQS

SEQ ID NO: 430 - protein, 166 aa, Artificial Sequence
  source: /note="Description of Artificial Sequence: Synthetic polypeptide"
  source: /note="LPG50171 protein sequence"
MSDLELNDEYWMRHALTLAKRAREEGEVPVGAVLVLNNQVIGEGWNRAIGLHDPTAHAEIMALRQGGLVLQNYRLIDATLYVTFEPCVMCAGAMVHSRIARLVFGVRNSKRGAAGSLMNVLNYPGMNHRVEISEGVLAESCSAMLCDFYRWPREVKNALKKAREQN

SEQ ID NO: 431 - protein, 169 aa, Artificial Sequence
  source: /note="Description of Artificial Sequence: Synthetic polypeptide"
  source: /note="LPG50172 protein sequence"
MSDLELDHEYWMRHALLLAKRARDEGEVPVGAVLVLNNQVIGEGWNRAIGLHDPTAHAEIMALRQGGLVLQNYRLLDTTLYVTFEPCVMCSGAMVHSRIGTLVYGVRNEKRGAAGSLMNVLGYPGMNHQVQVIDGVLAPECSGLLCDFYRMPRQQKNQQKAESTSSRGD

SEQ ID NO: 432 - protein, 162 aa, Artificial Sequence
  source: /note="Description of Artificial Sequence: Synthetic polypeptide"
  source: /note="LPG50173 protein sequence"
MSDTELTHEYWMRHALMLAQRARDEGEVPVGAVLVLNNRVIGEGWNRAIGLHDPTAHAEIMALRQGGLVLQNYRLLDTTLYVTFEPCVMCAGAMVHGRIGTLVFGVRNLKRGAAGSLMNVLNYPGMNHRVEIVEGTLSDECSGMLCEFYRQPRLAFNAQKQA

SEQ ID NO: 433 - protein, 173 aa, Artificial Sequence
  source: /note="Description of Artificial Sequence: Synthetic polypeptide"
  source: /note="LPG50174 protein sequence"
MSIPELNHDVWMRHALTLAKRAREEGEVPVGAVLVLNGQVIGEGWNRAIGLHDPTAHAEIMALRQGGLVLQNYRLIDTTLYVTFEPCVMCAGAMVHSRIGQLVFGVRNSKRGAAGSLMNVLNYPGMNHRVEITEGVLRDECAAMLCDFYRQPRLVKNALKKPAGDPSALQNNR

SEQ ID NO: 434 - protein, 166 aa, Artificial Sequence
  source: /note="Description of Artificial Sequence: Synthetic polypeptide"
  source: /note="LPG50175 protein sequence"
MSDLELNDEYWMRHALTLAKRAREEGEVPVGAVLVLNNQVIGEGWNRAIGLHDPTAHAEIMALRQGGLVLQNYRLIDATLYVTFEPCVMCAGAMVHSRIARLVFGVRNSKRGAAGSLMNVLNYPGMNHRVEISEGVLAGSCSAMLCDFYRWPREVKNALKKAREQN

SEQ ID NO: 435 - protein, 153 aa, Artificial Sequence
  source: /note="Description of Artificial Sequence: Synthetic polypeptide"
  source: /note="LPG50176 protein sequence"
MSDIEQNHEYWMRHALVLAKRAREEGEVPVGAVLVLNNQVIGEGWNRAIGLHDPTAHAEIMALRQGGLVLQNYRLIDTTLYVTFEPCVMCAGAMVHGRIGSLVFGVRNSKRGAAGSLINVLNYPGMNHRVEMTEGVLADECSAMLCDFYRHPR

SEQ ID NO: 436 - protein, 168 aa, Artificial Sequence
  source: /note="Description of Artificial Sequence: Synthetic polypeptide"
  source: /note="LPG50177 protein sequence"
MCNPERDHEYWMRHALTLAQRARDEGEVPVGAVLVLNNQVIGEGWNRAIGLHDPTAHAEIMALRQGGMVLQNYRLLDTTLYVTFEPCVMCSGAMVHSRIGTLVFGVRNEKRGAAGSLLNVLGYPGMNHQVKTIGGVLAPACSALLCDFYRMPRQQKNQQKAELKLSND

SEQ ID NO: 437 - protein, 162 aa, Artificial Sequence
  source: /note="Description of Artificial Sequence: Synthetic polypeptide"
  source: /note="LPG50178 protein sequence"
MSAIELNHEYWMRHALGLAQRARDEGEVPVGAVLVYQNQVIGEGWNRAIGLHDPTAHAEIMALRQGGLVLQNYRLIDTTLYVTFEPCVMCAGAMVHSRIGRVVFGVRNSKRGAAGSLMNVLNYPGMNHRVEVTEGVLAGECSAMLCDFYRAPRAQFNAQKRP

SEQ ID NO: 438 - protein, 169 aa, Artificial Sequence
  source: /note="Description of Artificial Sequence: Synthetic polypeptide"
  source: /note="LPG50179 protein sequence"
MSNPELNHEYWMRYALTLAKRAREEGEVPVGAVLVLNERVIGEGWNRAIGLHDPTAHAEIMALRQGGMVLQNYRLIDTTLYVTFEPCVMCAGAMVHSRIGHLVFGVRNSKRGAAGSLMNVLNYPGMNHRVAITEGVLRDECAAMLCDFYRQPRQVKNALKKTLSDSQEQ

SEQ ID NO: 439 - protein, 168 aa, Artificial Sequence
  source: /note="Description of Artificial Sequence: Synthetic polypeptide"
  source: /note="LPG50180 protein sequence"
MSNPEHDHEYWMRHALNLAQRARDEGEVPVGAVLVLNNQVIGEGWNRAIGLHDPTAHAEIMALRQGGLVLQNYRLLDTTLYVTFEPCVMCSGAMVHSRIGTLVYGVRNEKRGAAGSLMNVLGYPGMNHQVNVIGGVLAQDCSARLCDFYRMPRQQKNQQRAELKAQGD

SEQ ID NO: 440 - protein, 168 aa, Artificial Sequence
  source: /note="Description of Artificial Sequence: Synthetic polypeptide"
  source: /note="LPG50181 protein sequence"
MSDPELNHEYWMRHALQLAQRARDEGEVPVGAVLVLNNQVIGEGWNRAIGLHDPTAHAEIMALRQGGLVLQNYRLLDTTLYVTFEPCVMCSGAMIHSRIGTVVYGVRNEKRGAAGSLLNVLSYPGMNHQVKVIGEVLAPACSAMLCDFYRMPRQQKNQQKAEWKLSGE

SEQ ID NO: 441 - protein, 171 aa, Artificial Sequence
  source: /note="Description of Artificial Sequence: Synthetic polypeptide"
  source: /note="LPG50182 protein sequence"
MSNPELNHEYWMRYALTLAKRARDEGEVPVGAVLVYHDQVIGEGWNRAIGLHDPTAHAEIMALRQGGLVLQNYRLIDTTLYVTFEPCVMCAGAMVHSRIGRLVFGVRNSKRGAAGSLLNVLNYPGMNHQIDMEEGVLRDECAAMLCDFYRLPRIVKNALKQSPPDSTNLHA

SEQ ID NO: 442 - protein, 32 aa, Artificial Sequence
  source: /note="Description of Artificial Sequence: Synthetic polypeptide"
  source: /note="L32 Linker sequence"
SGGSSGGSSGSETPGTSESATPESSGGSSGGS

SEQ ID NO: 443 - DNA, 507 bp, Artificial Sequence
  source: /note="Description of Artificial Sequence: Synthetic polynucleotide"
  source: /note="Mammalian codon optimized LPG50140"
atgtctgatctggaactgaatcacgagtactggatgcggcacgccctgcaactggccaagcgggccagagatgagggcgaggtgccagtgggcgccgtgctggtgctgaacaaccaggtcatcggagaaggctggaacagagccatcggcctgcatgaccccacagcccatgccgaaatcatggccctgagacagggcggactggtgctgcagaactataggctgattgacaccaccctgtacgtgaccttcgagccttgtgtgatgtgctccggcgctatggtgcacagcagaatcggcacactggtctttggcgttagaaacagcaagcgcggagctgctggcagcctgatgaatgtgctgaactaccccggcatgaaccaccaggtgcaaatcatcgacggcgtgctcgcccctgaatgcagcggactgctgtgcgacttctaccggatgcctagacaggtgttcaaccagcagaaagccgagagcacctctatcaacggcgac

SEQ ID NO: 444 - DNA, 492 bp, Artificial Sequence
  source: /note="Description of Artificial Sequence: Synthetic polynucleotide"
  source: /note="Mammalian codon optimized LPG50141"
atgtccaaccccgagctgacccacgagcactggatgagatacgccctgacactggccaagcgggccagagaggaaggcgaagtgccagtgggcgccgtgctggtgctgaacaaccaggtgatcggagaaggctggaatagagccattggactgcatgatcctacagcccacgccgaaatcatggccctgagacagggcggcctggtgctgcagaactatagactgatcgacaccaccctgtacgtgacattcgagccttgtgtgatgtgcgccggcgccatggtgcacagcagaatcggccagctggtctttggcgtgcggaacagcaaacggggcgctgcaggctctctgatgaatgtgctcaactaccccggcatgaaccacagaatcgagttcaccgagggagttctgcgggacgagtgcgctgctatgctgtgcgacttctaccgccagcctagacaagtgttcaacgccctgaagaccggcaacgcc

SEQ ID NO: 445 - DNA, 507 bp, Artificial Sequence
  source: /note="Description of Artificial Sequence: Synthetic polynucleotide"
  source: /note="Mammalian codon optimized LPG50142"
atgagcatccccgagctgaaccacgacgtgtggatgcggcacgctcttacactggccaagcgggccagagaagaaggcgaagtgccagtgggcgccgtgctggttctgaacggccaggtgatcggcgagggctggaacagagccattggactgcatgaccctaccgcccacgccgagatcatggccctgagacagggcggactggtgctgcagaactatcggctgatcgacaccaccctgtacgtgaccttcgagccttgcgtgatgtgcgccggcgctatggtgcacagcagaatcggccagctggtgttcggcgtgcggaactccaagaggggcgccgctggatctctgatcaacgtgctgaattaccccggcatgaaccatagagtcgccatcacagagggagtgctcagagaggaatgtgccgccatgctgtgcgacttctacagacaacctagacaggtctttaacgccctgaagaaacctgctggcgatatcaatgccttc

SEQ ID NO: 446 - DNA, 516 bp, Artificial Sequence
  source: /note="Description of Artificial Sequence: Synthetic polynucleotide"
  source: /note="Mammalian codon optimized LPG50143"
atgagcaaccccgagctgaatcacgagtactggatgcggtacgccctgacactggccaagcgggccagagatgaaggcgaagtgcctgtgggcgccgtgctggtgctgaacgaccaggtgatcggagaaggctggaatagagccattggcctgcatgaccccaccgcccacgccgagatcatggccctgagacagggcggactggttctgcagaactaccgcctgatcgacaccaccctgtacgtgacattcgagccttgtgtgatgtgcgccggcgccatggtgcattctagaatcggcagactggtgttcggcgtgcggaacagcaagaggggcgctgctggcagcctgctgaacgtgctcaattatcctggaatgaaccaccacatcgagatggaagagggcgtgctgcgggacgagtgcgccgctatgctgtgcgacttctacagacagcctagacaggtctttaacgccctgaagaaatccccacctgatatcaacaacctgcaagctaga

SEQ ID NO: 447 - DNA, 507 bp, Artificial Sequence
  source: /note="Description of Artificial Sequence: Synthetic polynucleotide"
  source: /note="Mammalian codon optimized LPG50144"
atgagcaaccctgagctgacacacgaccactggatgagacacgccctgaccctggcccagcgggccagaaacgagggcgaagtgcccgtgggcgctgtgctggtgctgaatggccaagtgatcggagaaggctggaacagagccatcggcctgcatgacccaacagcccacgccgagatcatggccctgcggcagggcggactggtcctccagaactatcggctgatcgacaccgtgctgtacgtgaccttcgagccttgtgtgatgtgcgccggcgccatggtgcactctagaatcggacagctggtctttggcgtgcggaatagcaagcgcggcgccgctggctccctgatcaacgtgcttaattaccccggcatgaaccacagagtggaaattatcgagggcgttctgagagatgagtgcgcagctatgctgtgcgacttctacagacatcctagacaggtgttcaacgccctgaaaaagaacgccggaaccatcaacacccag

SEQ ID NO: 448 - DNA, 498 bp, Artificial Sequence
  source: /note="Description of Artificial Sequence: Synthetic polynucleotide"
  source: /note="Mammalian codon optimized LPG50145"
atgagcgacaccgagctgaaccacgagtactggatgcggcacgccctgatgctggctaagcgggccagagatgagggcgaagtgcctgtgggcgccgtgctggtcctgaaaaaccaggtgatcggagaaggctggaatagagccatcggcctgcatgaccccaccgcccacgctgaaatcatggccctgagacagggaggcctggtgctccagaactatagactgattgataccacactgtacgtgacattcgagccttgtgtgatgtgcgccggcgccatggtgcactctagaatcggcaacctggtctttggcgtgcggaacagcaagaggggcgctgctggcagcctgatcaacgtgctgaattaccccggcatgaaccacagagtggaaatcgccgagggagttctggccgacgagtgctccgccatgctgtgcgacttctaccggcatcctagacaagtgttcaacgccctgaagcaggccgccaagcacatc

SEQ ID NO: 449 - DNA, 513 bp, Artificial Sequence
  source: /note="Description of Artificial Sequence: Synthetic polynucleotide"
  source: /note="Mammalian codon optimized LPG50146"
atgagcgacatcgagctgaatcacgagtactggatgcggcacgccctgatgctggccaaaagagccagagaggaaggagaagtgccagtgggcgccgtgctggtgctgaacaaccaggtgatcggcgaaggctggaaccgggccattggcctgcatgatcctaccgcccacgccgagatcatggccctgagacagggcggactggtgctccagaactatagactgatcgacacaacactgtacgtgaccttcgagccttgtgtgatgtgcgccggcgccatggtgcacagcagaatcggccacctggtctttggcgttagaaactctaagcgcggagctgctggctccctgatcaatgtgctgaactaccccggcatgaaccaccggatcgaattcaccgagggcgtgctggctgatgaatgcagcggcatgctgtgcgacttctacagataccctagacaagtgttcaacaccctgaagcaggccgctaaggccatcaaccccgccgcccag

SEQ ID NO: 450 - DNA, 519 bp, Artificial Sequence
  source: /note="Description of Artificial Sequence: Synthetic polynucleotide"
  source: /note="Mammalian codon optimized LPG50147"
atgagcatccctgagctgaatcacgatgtgtggatgcggcacgccctgacactggctaagagagccagggaagagggcgaagtgccagtgggagccgtgctggtgctgaacggccaggtgatcggagaaggctggaaccgggccatcggcctgcatgaccccaccgcccacgccgagattatggccctgagacagggcggactggtccttcaaaattatagactgatcgacaccaccctgtacgtgacattcgagccttgtgtgatgtgcgccggagccatggtgcactctagaatcggccagctggtgttcggcgtgcgcaacagcaagcggggcgctgctggctccctgatgaacgtgctgaactaccccggcatgaatcatagagtggaaatcaccgagggcgttctcagagatgagtgcgccgctatgctgtgcgacttctaccggcagcctagacaggtctttaacgccctgaagaaacctgccggcgacatcaacgccctgcagaacaacaga

SEQ ID NO: 451 - DNA, 504 bp, Artificial Sequence
  source: /note="Description of Artificial Sequence: Synthetic polynucleotide"
  source: /note="Mammalian codon optimized LPG50148"
atgagcaaccccgagttcacacacgagtactggatgcggcacgccctgacactggcccgcagagccagagatgagggcgaagtgcctgtgggcgccgtgctggtcctgaacaaccaggtgatcggcgaaggctggaaccgggccattggactgcatgaccccaccgcccacgccgaaatcatggccctgagacagggcggactggtgctgcagaactaccggctgatcgacaccaccctgtacgtgacattcgagccatgtgtgatgtgtagcggcgctatggtccattctagaatcggcaccctggttttcggcgtgcggaacagcaagagaggagctgctggcagcctgatgaacgtgctgaattatcctggaatgaatcaccaggtgaagaccatcggcggcgtgctcgcccctgaatgcagcggcctgctgtgcgacttctacagaatgcctagacaagtgtttaaccagcagaaagccgagctgaagtccatcaacgac

SEQ ID NO: 452 - DNA, 501 bp, Artificial Sequence
  source: /note="Description of Artificial Sequence: Synthetic polynucleotide"
  source: /note="Mammalian codon optimized LPG50149"
atgagcgacgccgagctgacccacgagtactggatgagacacgccctgacactggcccagcgcgccagagatgagggagaagtgccagtgggcgccgtgctggttctgaacaaccaggtgatcggcgagggctggaatagagccatcggcctgcatgaccccaccgcccatgctgaaatcatggccctgcggcagggcggcctggtgcaacagaactacagactgatcgacaccaccctgtacgtgacattcgagccttgtgtgatgtgcgccggagctatggtgcactccaggatcggaagactgatcttcggcgtgcggaacagcaagcggggcgcagctggatctctgattaacgtgctgaattatcctggcatgaaccacagagtggaagtggtggaaggcatcctgagagatgagtgcgccggcatgctgtgcgacttctaccggcaacctagacaggtctttaacgccctcaagaaaggcgccaccgacatcaac

SEQ ID NO: 453 - DNA, 501 bp, Artificial Sequence
  source: /note="Description of Artificial Sequence: Synthetic polynucleotide"
  source: /note="Mammalian codon optimized LPG50150"
atgagcgacgccgagctgacccacgagtactggatgagacacgccctgacactggcccagagagctagggatgagggagaagtccccgtgggtgctgttctggtgctcaacaaccaggtgatcggagagggctggaatagagccatcggcctgcatgatcctacagcccacgccgaaatcatggccctgagacagggcggactggtccagcagaactatcggctgctggacaccaccctgtacgtgaccttcgagccatgtgtgatgtgcgccggcgccatggtgcactctagaatcggcagactgatcttcggcgtgcggaacagcaagcggggcgccgctggctccctgattaacgtgctgaattaccctggcatgaaccacagagtggaagtggtggaaggcatcctgcgggacgagtgcgccggcatgctgtgcgctttttaccgccaacctagagccgtgaagaacgccctgaaaaagggcgccaccgacgtgctg

SEQ ID NO: 454 - DNA, 507 bp, Artificial Sequence
  source: /note="Description of Artificial Sequence: Synthetic polynucleotide"
  source: /note="Mammalian codon optimized LPG50151"
atgagcgacctggaactgaaccacgagtactggatgagacacgccctgcaactggcccagagggccagagatgagggagaagtgccagtgggcgccgtgctggtctacaacaaccaggttatcggcgaaggctggaatagagccattggcctgcatgaccccaccgcccatgctgaaatcatggccctgcggcagggcggactggtgctccagaactaccggctgctggacaccaccctgtatgtgacctttgagccttgtgtgatgtgctccggcgccatggtgcacagcagaatcggaacactggtgttcggcgtgcggaacgagaagcggggcgctgctggcagcctgatgaacgtgctgagataccccggcatgaatcaccaggtgcaaatcatcgacggcgtgctggcccctgaatgcagcggcctgctgtgcgacttctacagaatgcctagacagcagaaaaaccagcaaaaggccgagtctacatctagccctggagat

SEQ ID NO: 455 - DNA, 501 bp, Artificial Sequence
  source: /note="Description of Artificial Sequence: Synthetic polynucleotide"
  source: /note="Mammalian codon optimized LPG50152"
atgagcgacaacgagctgaaccacgagtactggatgcggcacgccctgggcctcgccaaaagagccagagaggaaggcgaggtgcccgtgggcgctgttctggtcctgaacaaccaggtgatcggagaaggctggaacagggccatcggcctgcatgacccaacagcccacgccgagatcatggctctgagacagggcggcctggtgctgcagaactatagactgacagataccaccctgtacgtgacctttgagccttgtgtgatgtgcgccggagcaatggtccacagcagaatcggcaccctggtgttcggcgtgcggaacagcaagcggggcgccgccggctctctgatgaacgtgctgaattaccccggcatgaatcatagagtggaaattgtggaaggaatcctgagcgagtcctgcgccgccatgctgtgcgacttctaccggcaacctagagccgtgaagaacgccctgaagaaggccgctgatcctgccgct

SEQ ID NO: 456 - DNA, 492 bp, Artificial Sequence
  source: /note="Description of Artificial Sequence: Synthetic polynucleotide"
  source: /note="Mammalian codon optimized LPG50153"
atgagcgatacagaattcacccacgagcactggatgagacacgccctgacactggctcaaagagcccgggacgagggcgaagtgccagtgggagccgtgctcgtgctgaacaaccaggttatcggcgaaggctggaatagagccatcggcctgcatgaccctaccgcccacgccgagatcatggccctgagacagggcggcctggtcctgcagaactataggctgctggacaccaccctgtacgtgacatttgagccttgtgtgatgtgcgccggcgcaatggtgcacagcagaatcggacatctggtgttcggcgtgcggaacagcaagcggggcgccatcggatctctgatgaacgtgctgggctaccccggcatgaatcaccaggtccaggtgtccgagggcgtgctggccaccgaatgcagcgctatgctgtgcgacttctaccgggctcctagactggtgaaaaacgccctgaaggaaaaggccaga

SEQ ID NO: 457 - DNA, 513 bp, Artificial Sequence
  source: /note="Description of Artificial Sequence: Synthetic polynucleotide"
  source: /note="Mammalian codon optimized LPG50154"
atgagcgagtccgagttcacccacgagcactggatgcggcacgccctgacactggccagaagagccagagaggaaggcgaggtgccagtgggagctgtgctggtgctgaacaaccaggtgatcggagaaggctggaacagagccatcggcctgcatgatcctaccgcccacgccgagatcatggccctgagacagggcggcctcgtcctgcagaactaccggctgctggacagcaccctgtatgtgacattcgagccctgtgtgatgtgcgccggcgctatggtgcacggcagaatcggaaatctggtctttggcgtgcggaacagcaagcggggcgccattggatctctgatgaatgtggtgggctaccccggcatgaaccaccaaatcaacgtgatcgagggcgttcttgcagaagaatgcagcgccatgctgtgcgacttctacagagcccctagactggtgaaaaacgccctgaaggaaaaggccagaaacggcaacaatcctaacaag

SEQ ID NO: 458 - DNA, 492 bp, Artificial Sequence
  source: /note="Description of Artificial Sequence: Synthetic polynucleotide"
  source: /note="Mammalian codon optimized LPG50155"
atgagcaaccccgagctgacacacgagcactggatgagatacgccctgacactggccaagcgggccagagaggaaggcgaagtgccagtgggcgccgtgctggttctgaacaaccaggtgatcggcgaaggctggaacagagccatcggcctgcatgatcctaccgcccacgccgaaatcatggccctgagacagggcggactggtgctccagaactatagactgatcgacaccaccctgtacgtgaccttcgagccttgtgtgatgtgcgccggagctatggtgcactccagaattggccagctggtgttcggcgtgcggaacagcaagaggggcgctgctggctctctgatgaatgtgctgaattaccccggcatgaaccacagaatcgagtttacagagggagtgctgcgggacgagtgcgccgctatgctgtgcgacttctaccggcaacctagactggtcaagaacgccctgaaaaccggcaacgcc

SEQ ID NO: 459 - DNA, 498 bp, Artificial Sequence
  source: /note="Description of Artificial Sequence: Synthetic polynucleotide"
  source: /note="Mammalian codon optimized LPG50156"
atgagcgatcctgagctgaatcatgaatattggatgagacacgccctgcagctggctaaaagagccagagaggaaggcgaagtgcccgtgggagccgtgctcgtgctgaacaaccaggttatcggcgagggctggaacagagccatcggcctgcatgaccccaccgcccacgccgaaatcatggccctgcggcagggaggcctggtgctgcagaactaccggctgctggacaccacactgtacgtgaccttcgagccttgcgtgatgtgtagcggagctatgatccactctagaatcggcacagtggtctttggcgtgcggaacgagaagcgcggcgccgccggcagcctgctgaatgtgctgagatacccaggcatgaaccaccaggtgaacgtgctgggcggcgtcctggcccctgcttgttccgagatgctgtgcgaattctacagaatgcctagacagcagaagaaccggcaaaaggccgagagcaagctgagc

SEQ ID NO: 460 - DNA, 498 bp, Artificial Sequence
  source: /note="Description of Artificial Sequence: Synthetic polynucleotide"
  source: /note="Mammalian codon optimized LPG50157"
atgagcgacaacgagctgaatcacgagcactggatgcggcacgccctgacactggcccagcgcgccagagaggaaggcgaggtgcctgtgggcgccgtgctggtgctgcaaaaccaggtgatcggagaaggctggaatagagccatcggcctgcatgaccccaccgcccatgccgagatcatggccctgagacagggcggcatggtgctgcagaactaccggctgatcgacaccaccctgtacgtgaccttcgagccatgtgtgatgtgcgccggcgccatggtccactctagaatcggccagctggtctttggcgtgcggaacagcaagcggggcgctgctggcagcctgattaacgtgctgaactatcctggaatgaaccacagagtggaaatcacagagggagtgctggctgatgattgcagcagcatgctgtgcgacttctacagacaccctagagaacagaagaacgccctcaaaagagccgctcactccaac

SEQ ID NO: 461 - DNA, 504 bp, Artificial Sequence
  source: /note="Description of Artificial Sequence: Synthetic polynucleotide"
  source: /note="Mammalian codon optimized LPG50158"
atgagcaaccccgagcacaaccacgagtactggatgcggcacgccctgaccctggcccagagggccagagatgagggagaagtgccagtgggcgccgtgctggtctacaacaaccaggttatcggcgaaggctggaacagagccatcggacttcatgatcctaccgcccacgctgaaatcatggccctgagacagggcggcctggtgctgcagaactaccggctgctggacacaaccctgtatgtgacctttgagccttgtgtgatgtgtagcggcgctatggtgcactctagaatcggaacactggtgttcggcgtgcgcaacgagaagcggggcgccgctggcagcctgatgaacgtgctgggctaccccggcatgaatcaccaggtgcaaaccatcggcggagtgctcgcccctgagtgctccggcctgctgtgcgacttctacagaatgcctagacaacagaaaaaccagcagaaggccgaactgaatcaacctggcgac

SEQ ID NO: 462 - DNA, 504 bp, Artificial Sequence
  source: /note="Description of Artificial Sequence: Synthetic polynucleotide"
  source: /note="Mammalian codon optimized LPG50159"
atgagcgacctggaactgaatcacgagtactggatgagacacgccctgagcctggctaagagagccagagatgagggcgaagtgcccgtgggcgccgtgctggtgctgaacaaccaggttatcggcgagggatggaaccgggccattggcctgcatgaccccaccgcccacgctgaaatcatggccctgaggcagggcggactggtgctccagaactacagactgctggacaccaccctgtacgtgacattcgagccatgtgtgatgtgctctggcgctatggtgcattctagaatcggaacactggtctacggcgtgcggaacgagaagcggggcgccgccggcagcctgatgaatgtgctgggctatcctggcatgaaccaccaggtgcaaatcatcggcggcgtgctggcccctgactgcagcggcctgctgtgcgacttctaccgcatgcctagacaacagaaaaaccagcagaaggccgagctgaagtccagcggagat

SEQ ID NO: 463 - DNA, 498 bp, Artificial Sequence
  source: /note="Description of Artificial Sequence: Synthetic polynucleotide"
  source: /note="Mammalian codon optimized LPG50160"
atgtctgatcacgagttcaacgatgagtactggatgcggcacgccctgaccctggctaaaagagccagggaagagggcgaggtgcctgtgggcgccgtgctggtgctgaacaaccaggtgatcggagaaggatggaatagagccatcggcctgcatgaccccaccgcccatgctgaaatcatggccctgagacaaggaggcctggtcctccagaactatcgcctgatcgacgccacactgtacgtgacctttgagccttgtgtgatgtgcgccggcgccatggtgcacagcagaatcagccggctggttttcggcgtgcggaacagcaagcggggcgctgctggcagcctgattaacgtgctgaattaccccggcatgaaccacagagtggaaatcacagagggcatcctggccgagtcctgcagcgccatgctgtgcgacttctacagatggcctagagaggtgaagaacgccctgaagaaggccagacaggaggaa

SEQ ID NO: 464 - DNA, 498 bp, Artificial Sequence
  source: /note="Description of Artificial Sequence: Synthetic polynucleotide"
  source: /note="Mammalian codon optimized LPG50161"
atgagccagaccgaactgacccacgagtattggatgcggcacgccctgacactggcccaaagagccagagacgagggcgaagtgccagtgggcgccgtgctggtgctgaacaaccaggtcatcggcgaaggctggaatagggccattggactgcatgatcctaccgcccacgccgagatcatggccctgagacagggcggcctggtcctccagaactaccggctgctggacaccaccctgtacgtgaccttcgagccttgtgtgatgtgcgccggagctatggtgcacggcagaatcggaacactggtgttcggcgtgcggaacagcaaaagaggcgctgttggatctctgatgaatatcacaggctaccccggcatgaaccaccaggtgcaagtgatcgagggcatcctggctacagagtgctccgccatgctgtgcgctttttaccgccagcctagactggtgaagaacgccctgaaggaagccgccaagaccgcc

SEQ ID NO: 465 - DNA, 501 bp, Artificial Sequence
  source: /note="Description of Artificial Sequence: Synthetic polynucleotide"
  source: /note="Mammalian codon optimized LPG50162"
atgagcaaccccgagctgaaccatgattactggatgcggcacgccctgagcctggccaagcgggccagagaggaaggcgaagtgccagtgggcgccgtgctggtgcggaacaacgaggtgatcggcgagggatggaacagagccatcggcctgcatgaccctacagcccacgccgagatcatggccctgagacagggcggcatggtcctccagaactatagactgatcgacaccaccctgtacgtgaccttcgagccttgtgtgatgtgcgccggcgccatggtgcacagcagaatcggccagctggtctttggcgttagaaattctaagcgcggagctgctggttccctgatgaacgtgctgaattaccccggcatgaaccacagagtggaaatcgtggaaggcgtgctgcgggacgagtgcgccggaatgctgtgcgacttctacaggcaacctagactggtgaagaacgcccagaaaaagggcgctgaacctctgatt

SEQ ID NO: 466 - DNA, 516 bp, Artificial Sequence
  source: /note="Description of Artificial Sequence: Synthetic polynucleotide"
  source: /note="Mammalian codon optimized LPG50163"
atgagcaaccccgagctgaatcacgagtactggatgagatacgccctgaccctggccaagagagccagagacgaaggagaggtgcctgtgggcgctgttctggtgtacaacgaccaggtgatcggcgaaggctggaaccgggccatcggcctgcatgaccccaccgcccacgccgagattatggccctgcgccagggcggcctggtgctgcagaactaccggctgatcgacacaaccctgtacgtgacatttgagccctgcgtgatgtgcgccggagcaatggtgcacagcagaatcggcagactggtgttcggcgtgcggaacagcaagcggggcgctgctggctctctgctgaacgtgctcaattatcctggaatgaaccatcacatcgagatggaagaaggcgtgctgagagatgagtgcgccgccatgctgtgtgatttctacagacaacctagaatggtcaagaacgcccttaaaaagtccccacctgacagccctaatctgcaggccaga

SEQ ID NO: 467 - DNA, 504 bp, Artificial Sequence
  source: /note="Description of Artificial Sequence: Synthetic polynucleotide"
  source: /note="Mammalian codon optimized LPG50164"
atgagcaaccccgaattcacccacgagtactggatgagacacgccctgaccctggctagacgcgcccgggacgagggcgaggtgccagtgggcgctgtgctggtcctcaacaaccaggtgatcggcgaaggctggaatagagccatcggcctgcatgatcctacagcccacgctgaaatcatggccctgagacagggcggcctggtgctgcagaactaccggctgctggacaccaccctgtacgtgacatttgagccttgtgtgatgtgtagcggcgccatggtgcactctagaatcggaacactggtgttcggcgtgcggaacgagaagcggggcgccgccggcagcctgatgaatgtgctgggatatcccggcatgaaccaccaggttaagaccatcggaggcgtgctggcccctgaatgcagcggactgctgtgcgacttctacagaatgcctagacagcaaaagaaccagcagaaagccgagctgaagtccagcggcgat

SEQ ID NO: 468 - DNA, 495 bp, Artificial Sequence
  source: /note="Description of Artificial Sequence: Synthetic polynucleotide"
  source: /note="Mammalian codon optimized LPG50165"
atgagcgacaacgagttcaaccacgagtactggatgagacacgccctgaccctggcccagcgcgccagagatgagggcgaggtgcctgtgggcgccgtgctggtcctcgataaccaggtgatcggagaaggctggaatagagccatcggcctgcatgaccctaccgcccacgccgagatcatggccctgaggcagggcggcatggtcctgcagaactatagactgatcaacgctacactgtacgtgaccttcgagccttgcgtgatgtgcgccggcgctatggttcattctagaatcggccacgtggtgttcggcgtgcggaacagcaagcggggcgccgctggcagcctgatgaacgtgctgaactaccccggcatgaatcacagagtggaagtgacagagggagtgctgcgggaacagtgtgccggcatgctgtgcgacttctaccgggaaccaagagaacaatttaacgccctgagaaaggctcagaaagcc

SEQ ID NO: 469 - DNA, 510 bp, Artificial Sequence
  source: /note="Description of Artificial Sequence: Synthetic polynucleotide"
  source: /note="Mammalian codon optimized LPG50166"
atgagcgacaacgagctgaatcacgagtactggatgagacacgccctgaccctggcccagcgggccagagatgagggagaagtgcccgtgggcgccgtgctcgtgctgaacaaccaggttatcggcgaaggctggaatagagccatcggcctgcatgatcctaccgcccacgctgaaatcatggccctgagacagggcggaatggtcctgcagaactatagactgatcgacgccacactgtacgtgacattcgagccatgtatcatgtgcgccggcgccatggtgcactctagaatcggccaggtggtgttcggcgtgcgcaacagcaagcggggcgctgccggctccctgattaacatcctgaactaccctggcatgaaccacagagtggacgtgaccgagggcgtgctgagcgagcggtgcgccaacatgctgtgcgacttctaccgggaacctagactgcaatttaacgcccagagaaaggccgagaaagccggaaatgccgctgct

SEQ ID NO: 470 - DNA, 507 bp, Artificial Sequence
  source: /note="Description of Artificial Sequence: Synthetic polynucleotide"
  source: /note="Mammalian codon optimized LPG50167"
atgagcaaccccgagctgacccacgaccactggatgcggcacgccctgaccctggcccagagagccagaaacgagggagaagtgcctgtgggcgctgttctggtgctgaacggccaagtgatcggcgaaggctggaacagagccatcggcctgcatgaccctaccgcccacgccgagatcatggccctgcggcagggcggactggtcctccagaactaccggctgatcgacaccgtgctgtacgtgacctttgagccttgtgtgatgtgcgctggcgccatggtccattctagaatcggccagctggtgttcggcgtgcgcaatagcaagcggggtgccgccggcagcctgattaacgtgctgaactatcctggcatgaaccacagagtggaaatcatcgagggcgtgctgagagatgagtgcgcagctatgctgtgcgacttctacagacaccccagactggtgaagaacgccctgaaaaagaatgccggaacatccccaacacag

SEQ ID NO: 471 - DNA, 498 bp, Artificial Sequence
  source: /note="Description of Artificial Sequence: Synthetic polynucleotide"
  source: /note="Mammalian codon optimized LPG50168"
atgagcgacacagagctgaaccacgagtactggatgcggcacgccctgatgctggctaaacgcgccagagatgagggagaagtgccagtgggcgccgtgctggtgctgaagaaccaggtgatcggcgaaggctggaacagagccatcggactgcatgaccctacagcccacgctgaaatcatggccctgagacagggcggcctggtcctccagaactatagactgatcgacaccaccctgtacgtgacctttgagccttgtgtgatgtgcgccggcgctatggtgcactctagaatcggaaatctggttttcggcgtgcggaacagcaagcggggcgccgctggctccctgattaacgtgctgaattaccccggcatgaaccacagagtggaaatcgccgagggcgtgctggccgacgaatgcagcgccatgctgtgcgacttctaccggcatcctagacagcagcaaaacgccctgaagcaggccgccaagcacgat

SEQ ID NO: 472 - DNA, 513 bp, Artificial Sequence
  source: /note="Description of Artificial Sequence: Synthetic polynucleotide"
  source: /note="Mammalian codon optimized LPG50169"
atgagcgacatcgagctgaatcacgagtactggatgagacacgccctgatgctggccaagagagccagagaggaaggcgaagtgcctgtgggcgccgtgctggtgctgaacaaccaggtgatcggagaaggatggaaccgggccatcggcctgcatgatcctacagcccacgccgagatcatggccctgaggcagggcggactggtcctccagaactacagactgatcgacaccaccctgtacgtgacctttgagccatgtgtgatgtgcgccggcgccatggtgcacagcagaatcggccacctggttttcggcgtgcggaacagcaagcggggcgctgctggctccctgattaacgtgctgaactatcctggcatgaaccacagaatcgaattcaccgagggcgtgctggctgatgagtgctctggcatgctgtgcgacttctacagataccctagacagcagcaaaatacactgaagcaggccgctaaagccaacccccccgccgcccag

SEQ ID NO: 473 - DNA, 495 bp, Artificial Sequence
  source: /note="Description of Artificial Sequence: Synthetic polynucleotide"
  source: /note="Mammalian codon optimized LPG50170"
atgagcgacaacgagctgaaccacgagagatggatgcggcatgccctgaccctggctcaaagagccagagatgagggcgaggtgccagtgggcgctgtgctggtctaccagaaccaggtgatcggcgaaggctggaacagagccattggcctgcatgaccctaccgcccacgccgagatcatggccctgagacagggcggactggttctgcagaattaccggctgatcgacacaaccctgtacgtgacctttgagccttgtgtgatgtgcgccggcgccatggtgcactctagaatcggacagctggtgttcggcgtgcggaacagcaagcggggcgccgccggcagcctgatcaacgtgctcaattatcctggcatgaaccacagagtggccatcacagaaggagtgctggccgaatcctgcagcgccatgctgtgcgacttctacagacaccccagagaacagaagaacgccctgaggcgggctgctcagagc

SEQ ID NO: 474 - DNA, 498 bp, Artificial Sequence
  source: /note="Description of Artificial Sequence: Synthetic polynucleotide"
  source: /note="Mammalian codon optimized LPG50171"
atgagcgatctggaactgaacgacgagtactggatgcggcacgctctgaccctggccaagcgggccagagaagagggagaagtccccgtgggcgccgtgctcgttctgaacaaccaggtgatcggcgagggctggaacagagccattggactgcatgatcctaccgcccacgccgagatcatggccctgagacagggcggcctggtcctgcaaaattatagactgatcgacgccaccctgtacgtgacatttgagccttgtgtgatgtgcgccggcgctatggtgcacagcagaatcgccaggctggtgttcggcgtgcggaacagcaagcgcggcgccgctggatctctgatgaacgtgctgaattacccaggcatgaaccacagagtggaaatcagcgagggcgtgctggctgagtcctgcagcgccatgctgtgcgacttctacagatggcctagagaggtgaagaacgccctgaaaaaggcccgggaacagaac

SEQ ID NO: 475 - DNA, 507 bp, Artificial Sequence
  source: /note="Description of Artificial Sequence: Synthetic polynucleotide"
  source: /note="Mammalian codon optimized LPG50172"
atgagcgacctggaactggatcacgagtactggatgcggcacgccctgctgctggctaaaagagccagagatgagggcgaagtgcccgtgggcgccgtgctggtgctcaacaaccaggtcatcggagaaggctggaatagagccatcggcctgcatgacccaacagcccatgccgaaatcatggccctgaggcagggcggcctggtgctgcagaactacagactgctggacaccacactgtatgtgaccttcgagccttgtgtgatgtgctctggcgctatggtgcactctagaatcggaaccctggtctacggcgtgcggaacgagaagcggggcgccgctggctccctgatgaacgtgctgggctaccccggtatgaatcaccaggtgcaagtgatcgacggcgtgctggcccctgaatgcagcggactgctgtgcgacttctaccggatgcctagacagcaaaagaaccagcagaaggccgagagcaccagcagcagaggcgac

SEQ ID NO: 476 - DNA, 486 bp, Artificial Sequence
  source: /note="Description of Artificial Sequence: Synthetic polynucleotide"
  source: /note="Mammalian codon optimized LPG50173"
atgagcgacaccgagctgacccacgagtactggatgcggcacgccctgatgctggctcaaagagccagagatgaaggcgaagtgccagtgggagccgtgctggtcctgaacaaccgggtgatcggcgagggctggaacagagctatcggactgcatgatcctacagcccacgccgagatcatggccctgagacagggcggcctggtgctgcagaactaccgcctgctggacaccaccctgtacgttacatttgagccttgtgtgatgtgcgccggcgctatggtgcacggcagaatcggcacactggtgttcggcgtgcggaacctgaagcggggcgccgccggatctctgatgaatgtgctgaattatcctggcatgaaccacagagtggaaatcgtggaaggaaccctctccgacgaatgcagcggcatgctgtgcgagttctacagacagcccagactggccttcaacgcccagaagcaggcc

SEQ ID NO: 477 - DNA, 519 bp, Artificial Sequence
  source: /note="Description of Artificial Sequence: Synthetic polynucleotide"
  source: /note="Mammalian codon optimized LPG50174"
atgtctatccccgagctgaatcacgatgtgtggatgagacacgctctgacactggccaagagggctagagaggaaggcgaagtgccagtgggcgccgtgctggttctgaacggccaagtgatcggagaaggatggaacagagccatcggcctgcatgaccccaccgcccacgccgagattatggccctgcgccagggcggcctggtgctccagaactacagactgatcgacacaaccctgtacgtgaccttcgagccttgtgtgatgtgcgccggcgctatggtgcacagcagaatcggccagctggtctttggcgtgcggaacagcaagcggggcgccgctggttccctgatgaacgtgcttaattatcctggcatgaaccatagagtggaaatcaccgagggagtgctgagagatgagtgcgccgccatgctgtgcgacttctaccggcagcctagactggtcaagaacgccctgaagaaacctgccggcgaccctagcgccctgcagaacaaccgg

SEQ ID NO: 478 - DNA, 498 bp, Artificial Sequence
  source: /note="Description of Artificial Sequence: Synthetic polynucleotide"
  source: /note="Mammalian codon optimized LPG50175"
atgagcgatctggaactgaatgatgagtactggatgcggcacgccctgacactggccaagagagccagagaagagggcgaagtgcctgtcggcgccgtgctggtgctgaacaaccaggtgatcggcgagggctggaaccgggccatcggactgcatgaccccaccgcccatgccgagattatggccctgagacagggcggcctggttctgcaaaattatcgcctgatcgacgccaccctgtacgtgaccttcgagccttgtgtgatgtgcgccggagctatggtgcacagcagaatcgccaggctggtctttggcgtgcggaacagcaagcggggcgctgctggctccctgatgaacgtgctgaactacccaggcatgaaccacagagtggaaatcagcgagggagtgctcgctggctcttgcagcgccatgctgtgcgacttctacagatggcctagagaagtgaagaacgccctgaagaaagccagagagcagaac

SEQ ID NO: 479 - DNA, 459 bp, Artificial Sequence
  source: /note="Description of Artificial Sequence: Synthetic polynucleotide"
  source: /note="Mammalian codon optimized LPG50176"
atgagcgacatcgagcagaaccacgagtactggatgcggcacgccctggttctggccaagcgggccagagaggaaggcgaagtgccagtgggcgccgtgctggtgctgaacaaccaggtgatcggcgagggctggaacagggccatcggcctccatgatcctaccgcccacgccgaaatcatggccctgagacagggcggactggtcctgcaaaattaccggctgatcgacacaaccctgtacgtgacattcgagccttgtgtgatgtgcgccggcgctatggtgcacggcagaatcggcagcctggtctttggcgtgcggaacagcaagagaggcgccgctggctctctgattaacgtgctgaattatcctggaatgaaccacagagtggaaatgaccgagggcgtgctggctgatgaatgcagcgccatgctgtgcgacttctacagacaccccaga

SEQ ID NO: 480 - DNA, 504 bp, Artificial Sequence
  source: /note="Description of Artificial Sequence: Synthetic polynucleotide"
  source: /note="Mammalian codon optimized LPG50177"
atgtgcaaccctgagagagatcacgagtactggatgcggcacgccctgacactggcccagcgggccagagatgagggcgaagtgcctgtgggcgccgtgctggtgctgaacaaccaggttatcggcgaaggatggaatagagccatcggcctgcatgaccccaccgcccatgccgaaatcatggccctgagacagggcggcatggtgctgcagaactacagactgctggacaccaccctgtacgtgacctttgagccctgcgtgatgtgttccggcgccatggtccactctagaatcggtacactggtgttcggcgtgcggaacgagaagcggggcgctgctggcagcctgctgaatgtgctgggatatcctggcatgaaccaccaggtgaagaccatcggaggcgtgctcgccccagcttgcagcgccctgctgtgcgacttctaccgcatgcctagacaacagaaaaaccagcagaaggccgagctgaagctgagcaacgac

SEQ ID NO: 481 - DNA, 486 bp, Artificial Sequence
  source: /note="Description of Artificial Sequence: Synthetic polynucleotide"
  source: /note="Mammalian codon optimized LPG50178"
atgagcgccatcgagctgaaccacgagtactggatgcggcacgccctgggcctggctcagcgcgctagagatgagggcgaggtccccgtgggcgccgtgctggtctaccagaaccaggtgatcggcgaaggatggaaccgggccattggcctgcatgaccccacagcccacgccgaaatcatggccctgagacagggcggactggtgctgcagaattaccggctgatcgacaccaccctgtacgtgacattcgagccatgtgtgatgtgcgccggcgctatggtgcactctagaatcggtagagtggtgttcggcgttagaaacagcaagcggggcgccgccggcagcctgatgaacgtgctcaattatcctggcatgaaccatagagtggaagtgaccgagggcgtgctggccggagaatgctccgccatgctgtgcgacttctacagagcccctagggctcaatttaacgcccagaagagacct

SEQ ID NO: 482 - DNA, 507 bp, Artificial Sequence
  source: /note="Description of Artificial Sequence: Synthetic polynucleotide"
  source: /note="Mammalian codon optimized LPG50179"
atgagcaaccctgagctgaaccacgagtactggatgaggtacgccctgaccctggccaagcgggccagagaggaaggcgaagtgccagtgggcgccgtgctggttctgaacgaacgggtgatcggagaaggatggaacagagccatcggcctgcatgaccccaccgcccacgccgagatcatggccctcagacagggcggcatggtcctgcagaactatcggctgatcgacaccaccctgtacgtgacatttgagccttgcgtgatgtgcgccggcgctatggtgcactctagaatcggccacctggtgttcggcgtgcggaacagcaagagaggagctgctggttccctgatgaacgtgctgaattaccccggcatgaatcatagagtggccattacagagggcgtgctgagagatgaatgtgccgctatgctgtgcgacttctaccgccagcctagacaagtgaagaacgccctgaaaaagaccctgagcgatagccaggagcag

SEQ ID NO: 483 - DNA, 504 bp, Artificial Sequence
  source: /note="Description of Artificial Sequence: Synthetic polynucleotide"
  source: /note="Mammalian codon optimized LPG50180"
atgtccaatcctgagcacgaccacgagtactggatgcggcacgccctgaacctggcccagcgggccagagatgagggcgaggtgcccgtgggcgccgtgctggtgctcaacaaccaggtcatcggagaaggctggaaccgcgccatcggcctgcatgacccaacagcccatgctgaaatcatggccctgagacagggcggcctggtgctgcagaactaccggctgctggatacaaccctgtacgtgaccttcgagccctgcgtgatgtgtagcggcgctatggtgcacagccggatcggcaccctggtctacggcgttagaaacgagaaaagaggcgccgccggcagcctgatgaacgtgctgggatatcctggaatgaatcaccaggtgaacgtgatcggcggagtgctggctcaggactgttctgccagactgtgcgacttctacagaatgcctagacagcaaaagaaccagcagagagccgaactgaaggcccaaggcgac

SEQ ID NO: 484 - DNA, 504 bp, Artificial Sequence
  source: /note="Description of Artificial Sequence: Synthetic polynucleotide"
  source: /note="Mammalian codon optimized LPG50181"
atgagcgaccccgagctgaatcacgagtattggatgagacacgccctgcaactggcccagagagccagagatgagggcgaagtgccagtgggcgccgtgctggtcctgaacaaccaggtgattggagaaggctggaacagggccatcggactgcatgatcctacagcccacgccgaaatcatggccctgagacagggcggcctggtgctgcagaactaccggctgctggacaccaccctgtacgtgaccttcgagccttgcgtgatgtgctctggcgccatgatccacagcagaatcggaacagtggtgtacggcgtgcggaacgagaagcggggcgctgctggcagcctgctgaatgtgctctcctaccccggcatgaaccaccaggttaaggtgatcggcgaagtgctggcccctgcttgtagcgccatgctgtgcgacttctacagaatgcctagacagcagaaaaaccagcaaaaggccgagtggaagctgagcggcgag

SEQ ID NO: 485 - DNA, 513 bp, Artificial Sequence
  source: /note="Description of Artificial Sequence: Synthetic polynucleotide"
  source: /note="Mammalian codon optimized LPG50182"
atgagcaaccccgagctgaaccacgagtactggatgagatacgccctgacactggccaaaagagccagagacgagggagaagtgcccgtgggcgctgtgctggtctaccacgaccaagtgatcggcgaaggctggaacagagccatcggactgcatgatcctaccgcccacgccgagatcatggccctccggcagggaggcctggtgctgcagaactatagactgatcgacaccacactgtacgtgacctttgagccttgtgtgatgtgcgccggcgccatggtgcacagcagaattggcagactggttttcggcgtgcgcaactctaagcggggcgccgctggcagcctgctgaacgtgctgaattaccctggcatgaaccaccagatcgatatggaagaaggcgtgctgcgggatgagtgcgccgccatgctgtgcgacttctaccggctgcctagaatcgtgaagaatgcactgaagcagtcccctccagacagcaccaacctgcatgcc

SEQ ID NO: 486 - DNA, 3213 bp, Artificial Sequence
  source: /note="Description of Artificial Sequence: Synthetic polynucleotide"
  source: /note="Mammalian codon optimized nAPG07433.1"
atgagagagctggactacagaattggcctggccatcggcaccaacagcatcggatggggcgtgatcgagctgtcctggaacaaagaccgggagagatacgagaaggtcagaatcgtggatcaaggcgtgagaatgttcgacagagccgagatgcccaagacaggcgccagcttagctgaacccagaagaatcgccagatccagcagacggagactgaatcgcaagtcccagagaaagaaaaacatccggaacctgctggtgcaacacggcgtgatcacacaggaggaactggatagcctgtaccccctgagcaaaaagagcatggacatctggggcattcggctcgacggcctggacagactcctcaatcatttcgagtgggccagactgctgatccacctggctcagagacggggctttaagtccaacagaaagagtgaactgaaagatacagagacaggcaaggtgctgagcagcatccaactgaacgagaaacggctgagcttgtatagaaccgtgggcgagatgtggatgaaggaccccgacttctctaaatacgataggaagagaaatagccccaacgaatacgtgttcagcgtgtctagagccgagctggaaaaggaaatcgtgaccctgttcgccgcccagcggagattccagagcccttacgccagcaaagatctgcaggagacatatctgcagatctggacccaccaactgcctttcgccagcggcaatgccatcctgaacaaggtcggatactgctccctgttgaaaggcaaagaaagaaggattcccaaggctacatacaccttccaatacttctctgctctggaccaggtgaatcggaccagactgggacctgatttccagcccttcaccaaggagcaacgggaaattatcttgaacaacatgttccagaggacagattactacaagaagaaaaccatccccgaggtgacctactatgacatacggaagtggctggaattggacgagacaattcagttcaagggcctgaactacgaccctaacgaggaactgaagaagatcgagaagaagccttttatcaatctgaaggccttctacgagatcaacaaggtggtggccaactacagcgaaagaaccaacgagaccttctccaccctggactacgacggcatcggctacgccctgaccgtgtacaaaaccgacaaggatatccgcagctacctgaagagcagtcacaacctacctaagagatgctacgacgaccaactgatcgaggaactgctgagcctgagctacacaaagttcggccacctgtccctgaaagccatcaaccacgtgctgtctatcatgcagaagggcaatacctacaaggaagccgtggaccaactgggctacgacaccagcggccttaagaaggagaagaggtccaagttcctgccacctatttctgatgaaatcacgaatccaatcgtgaaaagggccctgacccaggccagaaaagtggtgaacgccataattagaagacacggatctcctcactccgtgcacatcgagctggccagagagctgagcaagaaccacgacgagcggacaaagatcgtcagcgcccaggatgaaaactacaagaaaaacaagggcgctatcagcatcctgtctgagcacggcatcctgaaccctacaggctacgacatcgtgagatacaaactgtggaaggagcagggcgaacggtgcgcctacagcctgaaggaaatccctgccgatacatttttcaacgagctgaagaaggaacgcaacggcgcccctatccttgaagtggaccacatcctgccctacagccagtccttcatcgactcctaccacaacaaggtcctggtgtacagcgacgaaaaccggaaaaagggcaacagaatcccttatacctacttcctggaaaccaacaaggattgggaggcctttgagcggtacgtgcggagcaacaaattcttctccaagaaaaagcgagagtaccttctgaagcgggcttatctgcctagagaatctgagctgatcaaagaacgccacctgaacgacaccagatacgcctctaccttcctgaagaacttcatcgagcagaacctgcagttcaaggaagccgaggacaaccccagaaaaagacgggtgcaaaccgtgaacggcgttatcaccgcccacttcagaaagcggtggggcctggagaaggaccggcaggagacatacctccatcacgctatggacgccatcatcgtggcttgtacagaccaccacatggtcaccagagtgaccgagtactatcagatcaaggaaagcaacaagagcgtgaagaagccctattttcctatgccttgggaaggcttccgggacgagctgctgagccacttggcttctcagcctatcgccaagaaaatcagcgaggaactgaaggccggctaccagagcctggactacatcttcgtgtccagaatgcctaagagaagcattacaggcgctgctcataagcagaccatcatgcggaagggaggaattgacaagaagggcaaaacaatcatcatcgaacggctgcacctgaaggatatcaagttcgacgagaacggagatttcaagatggtgggcaaggaacaggacatggccacatacgaagctattaaacagagatacctggagcacggcaagaatagcaagaaggccttcgagacccctctgtacaagcccagcaaaaagggcacaggtaacctgatcaagcgggtgaaggtggaaggacaggccaagagctttgtgagggaagtgaacggcggagtggcccaaaatggcgatctggttagagttgatttgtttgagaaggatgataagtactacatggtccccatctacgtgccagacaccgtgtgtagcgagctgcccaaaaaggtggtcgccagctctaagggctatgagcagtggctgacactggataacagcttcacctttaagttcagcctgtacccttatgatctggtgcggctggtcaagggagatgaggatcggttcctgtactttggcaccctggacatcgacagcgacagacttaacttcaaggacgtgaacaagccaagcaagaagaacgagtaccggtacagcttgaaaaccatcgaggacttggagaagtacgaggtgggcgtgctgggcgatctaagactggtccggaaggaaactcgaagaaacttccac

SEQ ID NO: 487 - DNA, 96 bp, Artificial Sequence
  source: /note="Description of Artificial Sequence: Synthetic oligonucleotide"
  source: /note="Codon optimized linker"
tccggcgggtcttccggcggctctagtgggagtgagacgccaggaacgtctgaatctgctactcccgaatctagcggcggatccagtggcggtagt

SEQ ID NO: 488 - protein, 1323 aa, Artificial Sequence
  source: /note="Description of Artificial Sequence: Synthetic polypeptide"
  source: /note="LPG50140-nAPG07433.1 protein sequence"
MAPKKKRKVDYKDHDGDYKDHDIDYKDDDDKMSDLELNHEYWMRHALQLAKRARDEGEVPVGAVLVLNNQVIGEGWNRAIGLHDPTAHAEIMALRQGGLVLQNYRLIDTTLYVTFEPCVMCSGAMVHSRIGTLVFGVRNSKRGAAGSLMNVLNYPGMNHQVQIIDGVLAPECSGLLCDFYRMPRQVFNQQKAESTSINGDSGGSSGGSSGSETPGTSESATPESSGGSSGGSMRELDYRIGLAIGTNSIGWGVIELSWNKDRERYEKVRIVDQGVRMFDRAEMPKTGASLAEPRRIARSSRRRLNRKSQRKKNIRNLLVQHGVITQEELDSLYPLSKKSMDIWGIRLDGLDRLLNHFEWARLLIHLAQRRGFKSNRKSELKDTETGKVLSSIQLNEKRLSLYRTVGEMWMKDPDFSKYDRKRNSPNEYVFSVSRAELEKEIVTLFAAQRRFQSPYASKDLQETYLQIWTHQLPFASGNAILNKVGYCSLLKGKERRIPKATYTFQYFSALDQVNRTRLGPDFQPFTKEQREIILNNMFQRTDYYKKKTIPEVTYYDIRKWLELDETIQFKGLNYDPNEELKKIEKKPFINLKAFYEINKVVANYSERTNETFSTLDYDGIGYALTVYKTDKDIRSYLKSSHNLPKRCYDDQLIEELLSLSYTKFGHLSLKAINHVLSIMQKGNTYKEAVDQLGYDTSGLKKEKRSKFLPPISDEITNPIVKRALTQARKVVNAIIRRHGSPHSVHIELARELSKNHDERTKIVSAQDENYKKNKGAISILSEHGILNPTGYDIVRYKLWKEQGERCAYSLKEIPADTFFNELKKERNGAPILEVDHILPYSQSFIDSYHNKVLVYSDENRKKGNRIPYTYFLETNKDWEAFERYVRSNKFFSKKKREYLLKRAYLPRESELIKERHLNDTRYASTFLKNFIEQNLQFKEAEDNPRKRRVQTVNGVITAHFRKRWGLEKDRQETYLHHAMDAIIVACTDHHMVTRVTEYYQIKESNKSVKKPYFPMPWEGFRDELLSHLASQPIAKKISEELKAGYQSLDYIFVSRMPKRSITGAAHKQTIMRKGGIDKKGKTIIIERLHLKDIKFDENGDFKMVGKEQDMATYEAIKQRYLEHGKNSKKAFETPLYKPSKKGTGNLIKRVKVEGQAKSFVREVNGGVAQNGDLVRVDLFEKDDKYYMVPIYVPDTVCSELPKKVVASSKGYEQWLTLDNSFTFKFSLYPYDLVRLVKGDEDRFLYFGTLDIDSDRLNFKDVNKPSKKNEYRYSLKTIEDLEKYEVGVLGDLRLVRKETRRNFHSGGSKRPAATKKAGQAKKKK

SEQ ID NO: 489 - protein, 1318 aa, Artificial Sequence
  source: /note="Description of Artificial Sequence: Synthetic polypeptide"
  source: /note="LPG50141-nAPG07433.1  protein sequence"
MAPKKKRKVDYKDHDGDYKDHDIDYKDDDDKMSNPELTHEHWMRYALTLAKRAREEGEVPVGAVLVLNNQVIGEGWNRAIGLHDPTAHAEIMALRQGGLVLQNYRLIDTTLYVTFEPCVMCAGAMVHSRIGQLVFGVRNSKRGAAGSLMNVLNYPGMNHRIEFTEGVLRDECAAMLCDFYRQPRQVFNALKTGNASGGSSGGSSGSETPGTSESATPESSGGSSGGSMRELDYRIGLAIGTNSIGWGVIELSWNKDRERYEKVRIVDQGVRMFDRAEMPKTGASLAEPRRIARSSRRRLNRKSQRKKNIRNLLVQHGVITQEELDSLYPLSKKSMDIWGIRLDGLDRLLNHFEWARLLIHLAQRRGFKSNRKSELKDTETGKVLSSIQLNEKRLSLYRTVGEMWMKDPDFSKYDRKRNSPNEYVFSVSRAELEKEIVTLFAAQRRFQSPYASKDLQETYLQIWTHQLPFASGNAILNKVGYCSLLKGKERRIPKATYTFQYFSALDQVNRTRLGPDFQPFTKEQREIILNNMFQRTDYYKKKTIPEVTYYDIRKWLELDETIQFKGLNYDPNEELKKIEKKPFINLKAFYEINKVVANYSERTNETFSTLDYDGIGYALTVYKTDKDIRSYLKSSHNLPKRCYDDQLIEELLSLSYTKFGHLSLKAINHVLSIMQKGNTYKEAVDQLGYDTSGLKKEKRSKFLPPISDEITNPIVKRALTQARKVVNAIIRRHGSPHSVHIELARELSKNHDERTKIVSAQDENYKKNKGAISILSEHGILNPTGYDIVRYKLWKEQGERCAYSLKEIPADTFFNELKKERNGAPILEVDHILPYSQSFIDSYHNKVLVYSDENRKKGNRIPYTYFLETNKDWEAFERYVRSNKFFSKKKREYLLKRAYLPRESELIKERHLNDTRYASTFLKNFIEQNLQFKEAEDNPRKRRVQTVNGVITAHFRKRWGLEKDRQETYLHHAMDAIIVACTDHHMVTRVTEYYQIKESNKSVKKPYFPMPWEGFRDELLSHLASQPIAKKISEELKAGYQSLDYIFVSRMPKRSITGAAHKQTIMRKGGIDKKGKTIIIERLHLKDIKFDENGDFKMVGKEQDMATYEAIKQRYLEHGKNSKKAFETPLYKPSKKGTGNLIKRVKVEGQAKSFVREVNGGVAQNGDLVRVDLFEKDDKYYMVPIYVPDTVCSELPKKVVASSKGYEQWLTLDNSFTFKFSLYPYDLVRLVKGDEDRFLYFGTLDIDSDRLNFKDVNKPSKKNEYRYSLKTIEDLEKYEVGVLGDLRLVRKETRRNFHSGGSKRPAATKKAGQAKKKK

SEQ ID NO: 490 - protein, 1323 aa, Artificial Sequence
  source: /note="Description of Artificial Sequence: Synthetic polypeptide"
  source: /note="LPG50142-nAPG07433.1  protein sequence"
MAPKKKRKVDYKDHDGDYKDHDIDYKDDDDKMSIPELNHDVWMRHALTLAKRAREEGEVPVGAVLVLNGQVIGEGWNRAIGLHDPTAHAEIMALRQGGLVLQNYRLIDTTLYVTFEPCVMCAGAMVHSRIGQLVFGVRNSKRGAAGSLINVLNYPGMNHRVAITEGVLREECAAMLCDFYRQPRQVFNALKKPAGDINAFSGGSSGGSSGSETPGTSESATPESSGGSSGGSMRELDYRIGLAIGTNSIGWGVIELSWNKDRERYEKVRIVDQGVRMFDRAEMPKTGASLAEPRRIARSSRRRLNRKSQRKKNIRNLLVQHGVITQEELDSLYPLSKKSMDIWGIRLDGLDRLLNHFEWARLLIHLAQRRGFKSNRKSELKDTETGKVLSSIQLNEKRLSLYRTVGEMWMKDPDFSKYDRKRNSPNEYVFSVSRAELEKEIVTLFAAQRRFQSPYASKDLQETYLQIWTHQLPFASGNAILNKVGYCSLLKGKERRIPKATYTFQYFSALDQVNRTRLGPDFQPFTKEQREIILNNMFQRTDYYKKKTIPEVTYYDIRKWLELDETIQFKGLNYDPNEELKKIEKKPFINLKAFYEINKVVANYSERTNETFSTLDYDGIGYALTVYKTDKDIRSYLKSSHNLPKRCYDDQLIEELLSLSYTKFGHLSLKAINHVLSIMQKGNTYKEAVDQLGYDTSGLKKEKRSKFLPPISDEITNPIVKRALTQARKVVNAIIRRHGSPHSVHIELARELSKNHDERTKIVSAQDENYKKNKGAISILSEHGILNPTGYDIVRYKLWKEQGERCAYSLKEIPADTFFNELKKERNGAPILEVDHILPYSQSFIDSYHNKVLVYSDENRKKGNRIPYTYFLETNKDWEAFERYVRSNKFFSKKKREYLLKRAYLPRESELIKERHLNDTRYASTFLKNFIEQNLQFKEAEDNPRKRRVQTVNGVITAHFRKRWGLEKDRQETYLHHAMDAIIVACTDHHMVTRVTEYYQIKESNKSVKKPYFPMPWEGFRDELLSHLASQPIAKKISEELKAGYQSLDYIFVSRMPKRSITGAAHKQTIMRKGGIDKKGKTIIIERLHLKDIKFDENGDFKMVGKEQDMATYEAIKQRYLEHGKNSKKAFETPLYKPSKKGTGNLIKRVKVEGQAKSFVREVNGGVAQNGDLVRVDLFEKDDKYYMVPIYVPDTVCSELPKKVVASSKGYEQWLTLDNSFTFKFSLYPYDLVRLVKGDEDRFLYFGTLDIDSDRLNFKDVNKPSKKNEYRYSLKTIEDLEKYEVGVLGDLRLVRKETRRNFHSGGSKRPAATKKAGQAKKKK

SEQ ID NO: 491 - protein, 1326 aa, Artificial Sequence
  source: /note="Description of Artificial Sequence: Synthetic polypeptide"
  source: /note="LPG50143-nAPG07433.1  protein sequence"
MAPKKKRKVDYKDHDGDYKDHDIDYKDDDDKMSNPELNHEYWMRYALTLAKRARDEGEVPVGAVLVLNDQVIGEGWNRAIGLHDPTAHAEIMALRQGGLVLQNYRLIDTTLYVTFEPCVMCAGAMVHSRIGRLVFGVRNSKRGAAGSLLNVLNYPGMNHHIEMEEGVLRDECAAMLCDFYRQPRQVFNALKKSPPDINNLQARSGGSSGGSSGSETPGTSESATPESSGGSSGGSMRELDYRIGLAIGTNSIGWGVIELSWNKDRERYEKVRIVDQGVRMFDRAEMPKTGASLAEPRRIARSSRRRLNRKSQRKKNIRNLLVQHGVITQEELDSLYPLSKKSMDIWGIRLDGLDRLLNHFEWARLLIHLAQRRGFKSNRKSELKDTETGKVLSSIQLNEKRLSLYRTVGEMWMKDPDFSKYDRKRNSPNEYVFSVSRAELEKEIVTLFAAQRRFQSPYASKDLQETYLQIWTHQLPFASGNAILNKVGYCSLLKGKERRIPKATYTFQYFSALDQVNRTRLGPDFQPFTKEQREIILNNMFQRTDYYKKKTIPEVTYYDIRKWLELDETIQFKGLNYDPNEELKKIEKKPFINLKAFYEINKVVANYSERTNETFSTLDYDGIGYALTVYKTDKDIRSYLKSSHNLPKRCYDDQLIEELLSLSYTKFGHLSLKAINHVLSIMQKGNTYKEAVDQLGYDTSGLKKEKRSKFLPPISDEITNPIVKRALTQARKVVNAIIRRHGSPHSVHIELARELSKNHDERTKIVSAQDENYKKNKGAISILSEHGILNPTGYDIVRYKLWKEQGERCAYSLKEIPADTFFNELKKERNGAPILEVDHILPYSQSFIDSYHNKVLVYSDENRKKGNRIPYTYFLETNKDWEAFERYVRSNKFFSKKKREYLLKRAYLPRESELIKERHLNDTRYASTFLKNFIEQNLQFKEAEDNPRKRRVQTVNGVITAHFRKRWGLEKDRQETYLHHAMDAIIVACTDHHMVTRVTEYYQIKESNKSVKKPYFPMPWEGFRDELLSHLASQPIAKKISEELKAGYQSLDYIFVSRMPKRSITGAAHKQTIMRKGGIDKKGKTIIIERLHLKDIKFDENGDFKMVGKEQDMATYEAIKQRYLEHGKNSKKAFETPLYKPSKKGTGNLIKRVKVEGQAKSFVREVNGGVAQNGDLVRVDLFEKDDKYYMVPIYVPDTVCSELPKKVVASSKGYEQWLTLDNSFTFKFSLYPYDLVRLVKGDEDRFLYFGTLDIDSDRLNFKDVNKPSKKNEYRYSLKTIEDLEKYEVGVLGDLRLVRKETRRNFHSGGSKRPAATKKAGQAKKKK

SEQ ID NO: 492 - protein, 1323 aa, Artificial Sequence
  source: /note="Description of Artificial Sequence: Synthetic polypeptide"
  source: /note="LPG50144-nAPG07433.1  protein sequence"
MAPKKKRKVDYKDHDGDYKDHDIDYKDDDDKMSNPELTHDHWMRHALTLAQRARNEGEVPVGAVLVLNGQVIGEGWNRAIGLHDPTAHAEIMALRQGGLVLQNYRLIDTVLYVTFEPCVMCAGAMVHSRIGQLVFGVRNSKRGAAGSLINVLNYPGMNHRVEIIEGVLRDECAAMLCDFYRHPRQVFNALKKNAGTINTQSGGSSGGSSGSETPGTSESATPESSGGSSGGSMRELDYRIGLAIGTNSIGWGVIELSWNKDRERYEKVRIVDQGVRMFDRAEMPKTGASLAEPRRIARSSRRRLNRKSQRKKNIRNLLVQHGVITQEELDSLYPLSKKSMDIWGIRLDGLDRLLNHFEWARLLIHLAQRRGFKSNRKSELKDTETGKVLSSIQLNEKRLSLYRTVGEMWMKDPDFSKYDRKRNSPNEYVFSVSRAELEKEIVTLFAAQRRFQSPYASKDLQETYLQIWTHQLPFASGNAILNKVGYCSLLKGKERRIPKATYTFQYFSALDQVNRTRLGPDFQPFTKEQREIILNNMFQRTDYYKKKTIPEVTYYDIRKWLELDETIQFKGLNYDPNEELKKIEKKPFINLKAFYEINKVVANYSERTNETFSTLDYDGIGYALTVYKTDKDIRSYLKSSHNLPKRCYDDQLIEELLSLSYTKFGHLSLKAINHVLSIMQKGNTYKEAVDQLGYDTSGLKKEKRSKFLPPISDEITNPIVKRALTQARKVVNAIIRRHGSPHSVHIELARELSKNHDERTKIVSAQDENYKKNKGAISILSEHGILNPTGYDIVRYKLWKEQGERCAYSLKEIPADTFFNELKKERNGAPILEVDHILPYSQSFIDSYHNKVLVYSDENRKKGNRIPYTYFLETNKDWEAFERYVRSNKFFSKKKREYLLKRAYLPRESELIKERHLNDTRYASTFLKNFIEQNLQFKEAEDNPRKRRVQTVNGVITAHFRKRWGLEKDRQETYLHHAMDAIIVACTDHHMVTRVTEYYQIKESNKSVKKPYFPMPWEGFRDELLSHLASQPIAKKISEELKAGYQSLDYIFVSRMPKRSITGAAHKQTIMRKGGIDKKGKTIIIERLHLKDIKFDENGDFKMVGKEQDMATYEAIKQRYLEHGKNSKKAFETPLYKPSKKGTGNLIKRVKVEGQAKSFVREVNGGVAQNGDLVRVDLFEKDDKYYMVPIYVPDTVCSELPKKVVASSKGYEQWLTLDNSFTFKFSLYPYDLVRLVKGDEDRFLYFGTLDIDSDRLNFKDVNKPSKKNEYRYSLKTIEDLEKYEVGVLGDLRLVRKETRRNFHSGGSKRPAATKKAGQAKKKK

SEQ ID NO: 493 - protein, 1320 aa, Artificial Sequence
  source: /note="Description of Artificial Sequence: Synthetic polypeptide"
  source: /note="LPG50145-nAPG07433.1  protein sequence"
MAPKKKRKVDYKDHDGDYKDHDIDYKDDDDKMSDTELNHEYWMRHALMLAKRARDEGEVPVGAVLVLKNQVIGEGWNRAIGLHDPTAHAEIMALRQGGLVLQNYRLIDTTLYVTFEPCVMCAGAMVHSRIGNLVFGVRNSKRGAAGSLINVLNYPGMNHRVEIAEGVLADECSAMLCDFYRHPRQVFNALKQAAKHISGGSSGGSSGSETPGTSESATPESSGGSSGGSMRELDYRIGLAIGTNSIGWGVIELSWNKDRERYEKVRIVDQGVRMFDRAEMPKTGASLAEPRRIARSSRRRLNRKSQRKKNIRNLLVQHGVITQEELDSLYPLSKKSMDIWGIRLDGLDRLLNHFEWARLLIHLAQRRGFKSNRKSELKDTETGKVLSSIQLNEKRLSLYRTVGEMWMKDPDFSKYDRKRNSPNEYVFSVSRAELEKEIVTLFAAQRRFQSPYASKDLQETYLQIWTHQLPFASGNAILNKVGYCSLLKGKERRIPKATYTFQYFSALDQVNRTRLGPDFQPFTKEQREIILNNMFQRTDYYKKKTIPEVTYYDIRKWLELDETIQFKGLNYDPNEELKKIEKKPFINLKAFYEINKVVANYSERTNETFSTLDYDGIGYALTVYKTDKDIRSYLKSSHNLPKRCYDDQLIEELLSLSYTKFGHLSLKAINHVLSIMQKGNTYKEAVDQLGYDTSGLKKEKRSKFLPPISDEITNPIVKRALTQARKVVNAIIRRHGSPHSVHIELARELSKNHDERTKIVSAQDENYKKNKGAISILSEHGILNPTGYDIVRYKLWKEQGERCAYSLKEIPADTFFNELKKERNGAPILEVDHILPYSQSFIDSYHNKVLVYSDENRKKGNRIPYTYFLETNKDWEAFERYVRSNKFFSKKKREYLLKRAYLPRESELIKERHLNDTRYASTFLKNFIEQNLQFKEAEDNPRKRRVQTVNGVITAHFRKRWGLEKDRQETYLHHAMDAIIVACTDHHMVTRVTEYYQIKESNKSVKKPYFPMPWEGFRDELLSHLASQPIAKKISEELKAGYQSLDYIFVSRMPKRSITGAAHKQTIMRKGGIDKKGKTIIIERLHLKDIKFDENGDFKMVGKEQDMATYEAIKQRYLEHGKNSKKAFETPLYKPSKKGTGNLIKRVKVEGQAKSFVREVNGGVAQNGDLVRVDLFEKDDKYYMVPIYVPDTVCSELPKKVVASSKGYEQWLTLDNSFTFKFSLYPYDLVRLVKGDEDRFLYFGTLDIDSDRLNFKDVNKPSKKNEYRYSLKTIEDLEKYEVGVLGDLRLVRKETRRNFHSGGSKRPAATKKAGQAKKKK

SEQ ID NO: 494 - protein, 1325 aa, Artificial Sequence
  source: /note="Description of Artificial Sequence: Synthetic polypeptide"
  source: /note="LPG50146-nAPG07433.1  protein sequence"
MAPKKKRKVDYKDHDGDYKDHDIDYKDDDDKMSDIELNHEYWMRHALMLAKRAREEGEVPVGAVLVLNNQVIGEGWNRAIGLHDPTAHAEIMALRQGGLVLQNYRLIDTTLYVTFEPCVMCAGAMVHSRIGHLVFGVRNSKRGAAGSLINVLNYPGMNHRIEFTEGVLADECSGMLCDFYRYPRQVFNTLKQAAKAINPAAQSGGSSGGSSGSETPGTSESATPESSGGSSGGSMRELDYRIGLAIGTNSIGWGVIELSWNKDRERYEKVRIVDQGVRMFDRAEMPKTGASLAEPRRIARSSRRRLNRKSQRKKNIRNLLVQHGVITQEELDSLYPLSKKSMDIWGIRLDGLDRLLNHFEWARLLIHLAQRRGFKSNRKSELKDTETGKVLSSIQLNEKRLSLYRTVGEMWMKDPDFSKYDRKRNSPNEYVFSVSRAELEKEIVTLFAAQRRFQSPYASKDLQETYLQIWTHQLPFASGNAILNKVGYCSLLKGKERRIPKATYTFQYFSALDQVNRTRLGPDFQPFTKEQREIILNNMFQRTDYYKKKTIPEVTYYDIRKWLELDETIQFKGLNYDPNEELKKIEKKPFINLKAFYEINKVVANYSERTNETFSTLDYDGIGYALTVYKTDKDIRSYLKSSHNLPKRCYDDQLIEELLSLSYTKFGHLSLKAINHVLSIMQKGNTYKEAVDQLGYDTSGLKKEKRSKFLPPISDEITNPIVKRALTQARKVVNAIIRRHGSPHSVHIELARELSKNHDERTKIVSAQDENYKKNKGAISILSEHGILNPTGYDIVRYKLWKEQGERCAYSLKEIPADTFFNELKKERNGAPILEVDHILPYSQSFIDSYHNKVLVYSDENRKKGNRIPYTYFLETNKDWEAFERYVRSNKFFSKKKREYLLKRAYLPRESELIKERHLNDTRYASTFLKNFIEQNLQFKEAEDNPRKRRVQTVNGVITAHFRKRWGLEKDRQETYLHHAMDAIIVACTDHHMVTRVTEYYQIKESNKSVKKPYFPMPWEGFRDELLSHLASQPIAKKISEELKAGYQSLDYIFVSRMPKRSITGAAHKQTIMRKGGIDKKGKTIIIERLHLKDIKFDENGDFKMVGKEQDMATYEAIKQRYLEHGKNSKKAFETPLYKPSKKGTGNLIKRVKVEGQAKSFVREVNGGVAQNGDLVRVDLFEKDDKYYMVPIYVPDTVCSELPKKVVASSKGYEQWLTLDNSFTFKFSLYPYDLVRLVKGDEDRFLYFGTLDIDSDRLNFKDVNKPSKKNEYRYSLKTIEDLEKYEVGVLGDLRLVRKETRRNFHSGGSKRPAATKKAGQAKKKK

SEQ ID NO: 495 - protein, 1327 aa, Artificial Sequence
  source: /note="Description of Artificial Sequence: Synthetic polypeptide"
  source: /note="LPG50147-nAPG07433.1  protein sequence"
MAPKKKRKVDYKDHDGDYKDHDIDYKDDDDKMSIPELNHDVWMRHALTLAKRAREEGEVPVGAVLVLNGQVIGEGWNRAIGLHDPTAHAEIMALRQGGLVLQNYRLIDTTLYVTFEPCVMCAGAMVHSRIGQLVFGVRNSKRGAAGSLMNVLNYPGMNHRVEITEGVLRDECAAMLCDFYRQPRQVFNALKKPAGDINALQNNRSGGSSGGSSGSETPGTSESATPESSGGSSGGSMRELDYRIGLAIGTNSIGWGVIELSWNKDRERYEKVRIVDQGVRMFDRAEMPKTGASLAEPRRIARSSRRRLNRKSQRKKNIRNLLVQHGVITQEELDSLYPLSKKSMDIWGIRLDGLDRLLNHFEWARLLIHLAQRRGFKSNRKSELKDTETGKVLSSIQLNEKRLSLYRTVGEMWMKDPDFSKYDRKRNSPNEYVFSVSRAELEKEIVTLFAAQRRFQSPYASKDLQETYLQIWTHQLPFASGNAILNKVGYCSLLKGKERRIPKATYTFQYFSALDQVNRTRLGPDFQPFTKEQREIILNNMFQRTDYYKKKTIPEVTYYDIRKWLELDETIQFKGLNYDPNEELKKIEKKPFINLKAFYEINKVVANYSERTNETFSTLDYDGIGYALTVYKTDKDIRSYLKSSHNLPKRCYDDQLIEELLSLSYTKFGHLSLKAINHVLSIMQKGNTYKEAVDQLGYDTSGLKKEKRSKFLPPISDEITNPIVKRALTQARKVVNAIIRRHGSPHSVHIELARELSKNHDERTKIVSAQDENYKKNKGAISILSEHGILNPTGYDIVRYKLWKEQGERCAYSLKEIPADTFFNELKKERNGAPILEVDHILPYSQSFIDSYHNKVLVYSDENRKKGNRIPYTYFLETNKDWEAFERYVRSNKFFSKKKREYLLKRAYLPRESELIKERHLNDTRYASTFLKNFIEQNLQFKEAEDNPRKRRVQTVNGVITAHFRKRWGLEKDRQETYLHHAMDAIIVACTDHHMVTRVTEYYQIKESNKSVKKPYFPMPWEGFRDELLSHLASQPIAKKISEELKAGYQSLDYIFVSRMPKRSITGAAHKQTIMRKGGIDKKGKTIIIERLHLKDIKFDENGDFKMVGKEQDMATYEAIKQRYLEHGKNSKKAFETPLYKPSKKGTGNLIKRVKVEGQAKSFVREVNGGVAQNGDLVRVDLFEKDDKYYMVPIYVPDTVCSELPKKVVASSKGYEQWLTLDNSFTFKFSLYPYDLVRLVKGDEDRFLYFGTLDIDSDRLNFKDVNKPSKKNEYRYSLKTIEDLEKYEVGVLGDLRLVRKETRRNFHSGGSKRPAATKKAGQAKKKK

SEQ ID NO: 496 - protein, 1322 aa, Artificial Sequence
  source: /note="Description of Artificial Sequence: Synthetic polypeptide"
  source: /note="LPG50148-nAPG07433.1  protein sequence"
MAPKKKRKVDYKDHDGDYKDHDIDYKDDDDKMSNPEFTHEYWMRHALTLARRARDEGEVPVGAVLVLNNQVIGEGWNRAIGLHDPTAHAEIMALRQGGLVLQNYRLIDTTLYVTFEPCVMCSGAMVHSRIGTLVFGVRNSKRGAAGSLMNVLNYPGMNHQVKTIGGVLAPECSGLLCDFYRMPRQVFNQQKAELKSINDSGGSSGGSSGSETPGTSESATPESSGGSSGGSMRELDYRIGLAIGTNSIGWGVIELSWNKDRERYEKVRIVDQGVRMFDRAEMPKTGASLAEPRRIARSSRRRLNRKSQRKKNIRNLLVQHGVITQEELDSLYPLSKKSMDIWGIRLDGLDRLLNHFEWARLLIHLAQRRGFKSNRKSELKDTETGKVLSSIQLNEKRLSLYRTVGEMWMKDPDFSKYDRKRNSPNEYVFSVSRAELEKEIVTLFAAQRRFQSPYASKDLQETYLQIWTHQLPFASGNAILNKVGYCSLLKGKERRIPKATYTFQYFSALDQVNRTRLGPDFQPFTKEQREIILNNMFQRTDYYKKKTIPEVTYYDIRKWLELDETIQFKGLNYDPNEELKKIEKKPFINLKAFYEINKVVANYSERTNETFSTLDYDGIGYALTVYKTDKDIRSYLKSSHNLPKRCYDDQLIEELLSLSYTKFGHLSLKAINHVLSIMQKGNTYKEAVDQLGYDTSGLKKEKRSKFLPPISDEITNPIVKRALTQARKVVNAIIRRHGSPHSVHIELARELSKNHDERTKIVSAQDENYKKNKGAISILSEHGILNPTGYDIVRYKLWKEQGERCAYSLKEIPADTFFNELKKERNGAPILEVDHILPYSQSFIDSYHNKVLVYSDENRKKGNRIPYTYFLETNKDWEAFERYVRSNKFFSKKKREYLLKRAYLPRESELIKERHLNDTRYASTFLKNFIEQNLQFKEAEDNPRKRRVQTVNGVITAHFRKRWGLEKDRQETYLHHAMDAIIVACTDHHMVTRVTEYYQIKESNKSVKKPYFPMPWEGFRDELLSHLASQPIAKKISEELKAGYQSLDYIFVSRMPKRSITGAAHKQTIMRKGGIDKKGKTIIIERLHLKDIKFDENGDFKMVGKEQDMATYEAIKQRYLEHGKNSKKAFETPLYKPSKKGTGNLIKRVKVEGQAKSFVREVNGGVAQNGDLVRVDLFEKDDKYYMVPIYVPDTVCSELPKKVVASSKGYEQWLTLDNSFTFKFSLYPYDLVRLVKGDEDRFLYFGTLDIDSDRLNFKDVNKPSKKNEYRYSLKTIEDLEKYEVGVLGDLRLVRKETRRNFHSGGSKRPAATKKAGQAKKKK

SEQ ID NO: 497 - protein, 1321 aa, Artificial Sequence
  source: /note="Description of Artificial Sequence: Synthetic polypeptide"
  source: /note="LPG50149-nAPG07433.1  protein sequence"
MAPKKKRKVDYKDHDGDYKDHDIDYKDDDDKMSDAELTHEYWMRHALTLAQRARDEGEVPVGAVLVLNNQVIGEGWNRAIGLHDPTAHAEIMALRQGGLVQQNYRLIDTTLYVTFEPCVMCAGAMVHSRIGRLIFGVRNSKRGAAGSLINVLNYPGMNHRVEVVEGILRDECAGMLCDFYRQPRQVFNALKKGATDINSGGSSGGSSGSETPGTSESATPESSGGSSGGSMRELDYRIGLAIGTNSIGWGVIELSWNKDRERYEKVRIVDQGVRMFDRAEMPKTGASLAEPRRIARSSRRRLNRKSQRKKNIRNLLVQHGVITQEELDSLYPLSKKSMDIWGIRLDGLDRLLNHFEWARLLIHLAQRRGFKSNRKSELKDTETGKVLSSIQLNEKRLSLYRTVGEMWMKDPDFSKYDRKRNSPNEYVFSVSRAELEKEIVTLFAAQRRFQSPYASKDLQETYLQIWTHQLPFASGNAILNKVGYCSLLKGKERRIPKATYTFQYFSALDQVNRTRLGPDFQPFTKEQREIILNNMFQRTDYYKKKTIPEVTYYDIRKWLELDETIQFKGLNYDPNEELKKIEKKPFINLKAFYEINKVVANYSERTNETFSTLDYDGIGYALTVYKTDKDIRSYLKSSHNLPKRCYDDQLIEELLSLSYTKFGHLSLKAINHVLSIMQKGNTYKEAVDQLGYDTSGLKKEKRSKFLPPISDEITNPIVKRALTQARKVVNAIIRRHGSPHSVHIELARELSKNHDERTKIVSAQDENYKKNKGAISILSEHGILNPTGYDIVRYKLWKEQGERCAYSLKEIPADTFFNELKKERNGAPILEVDHILPYSQSFIDSYHNKVLVYSDENRKKGNRIPYTYFLETNKDWEAFERYVRSNKFFSKKKREYLLKRAYLPRESELIKERHLNDTRYASTFLKNFIEQNLQFKEAEDNPRKRRVQTVNGVITAHFRKRWGLEKDRQETYLHHAMDAIIVACTDHHMVTRVTEYYQIKESNKSVKKPYFPMPWEGFRDELLSHLASQPIAKKISEELKAGYQSLDYIFVSRMPKRSITGAAHKQTIMRKGGIDKKGKTIIIERLHLKDIKFDENGDFKMVGKEQDMATYEAIKQRYLEHGKNSKKAFETPLYKPSKKGTGNLIKRVKVEGQAKSFVREVNGGVAQNGDLVRVDLFEKDDKYYMVPIYVPDTVCSELPKKVVASSKGYEQWLTLDNSFTFKFSLYPYDLVRLVKGDEDRFLYFGTLDIDSDRLNFKDVNKPSKKNEYRYSLKTIEDLEKYEVGVLGDLRLVRKETRRNFHSGGSKRPAATKKAGQAKKKK

SEQ ID NO: 498 - protein, 1321 aa, Artificial Sequence
  source: /note="Description of Artificial Sequence: Synthetic polypeptide"
  source: /note="LPG50150-nAPG07433.1  protein sequence"
MAPKKKRKVDYKDHDGDYKDHDIDYKDDDDKMSDAELTHEYWMRHALTLAQRARDEGEVPVGAVLVLNNQVIGEGWNRAIGLHDPTAHAEIMALRQGGLVQQNYRLLDTTLYVTFEPCVMCAGAMVHSRIGRLIFGVRNSKRGAAGSLINVLNYPGMNHRVEVVEGILRDECAGMLCAFYRQPRAVKNALKKGATDVLSGGSSGGSSGSETPGTSESATPESSGGSSGGSMRELDYRIGLAIGTNSIGWGVIELSWNKDRERYEKVRIVDQGVRMFDRAEMPKTGASLAEPRRIARSSRRRLNRKSQRKKNIRNLLVQHGVITQEELDSLYPLSKKSMDIWGIRLDGLDRLLNHFEWARLLIHLAQRRGFKSNRKSELKDTETGKVLSSIQLNEKRLSLYRTVGEMWMKDPDFSKYDRKRNSPNEYVFSVSRAELEKEIVTLFAAQRRFQSPYASKDLQETYLQIWTHQLPFASGNAILNKVGYCSLLKGKERRIPKATYTFQYFSALDQVNRTRLGPDFQPFTKEQREIILNNMFQRTDYYKKKTIPEVTYYDIRKWLELDETIQFKGLNYDPNEELKKIEKKPFINLKAFYEINKVVANYSERTNETFSTLDYDGIGYALTVYKTDKDIRSYLKSSHNLPKRCYDDQLIEELLSLSYTKFGHLSLKAINHVLSIMQKGNTYKEAVDQLGYDTSGLKKEKRSKFLPPISDEITNPIVKRALTQARKVVNAIIRRHGSPHSVHIELARELSKNHDERTKIVSAQDENYKKNKGAISILSEHGILNPTGYDIVRYKLWKEQGERCAYSLKEIPADTFFNELKKERNGAPILEVDHILPYSQSFIDSYHNKVLVYSDENRKKGNRIPYTYFLETNKDWEAFERYVRSNKFFSKKKREYLLKRAYLPRESELIKERHLNDTRYASTFLKNFIEQNLQFKEAEDNPRKRRVQTVNGVITAHFRKRWGLEKDRQETYLHHAMDAIIVACTDHHMVTRVTEYYQIKESNKSVKKPYFPMPWEGFRDELLSHLASQPIAKKISEELKAGYQSLDYIFVSRMPKRSITGAAHKQTIMRKGGIDKKGKTIIIERLHLKDIKFDENGDFKMVGKEQDMATYEAIKQRYLEHGKNSKKAFETPLYKPSKKGTGNLIKRVKVEGQAKSFVREVNGGVAQNGDLVRVDLFEKDDKYYMVPIYVPDTVCSELPKKVVASSKGYEQWLTLDNSFTFKFSLYPYDLVRLVKGDEDRFLYFGTLDIDSDRLNFKDVNKPSKKNEYRYSLKTIEDLEKYEVGVLGDLRLVRKETRRNFHSGGSKRPAATKKAGQAKKKK

SEQ ID NO: 499 - protein, 1323 aa, Artificial Sequence
  source: /note="Description of Artificial Sequence: Synthetic polypeptide"
  source: /note="LPG50151-nAPG07433.1  protein sequence"
MAPKKKRKVDYKDHDGDYKDHDIDYKDDDDKMSDLELNHEYWMRHALQLAQRARDEGEVPVGAVLVYNNQVIGEGWNRAIGLHDPTAHAEIMALRQGGLVLQNYRLLDTTLYVTFEPCVMCSGAMVHSRIGTLVFGVRNEKRGAAGSLMNVLRYPGMNHQVQIIDGVLAPECSGLLCDFYRMPRQQKNQQKAESTSSPGDSGGSSGGSSGSETPGTSESATPESSGGSSGGSMRELDYRIGLAIGTNSIGWGVIELSWNKDRERYEKVRIVDQGVRMFDRAEMPKTGASLAEPRRIARSSRRRLNRKSQRKKNIRNLLVQHGVITQEELDSLYPLSKKSMDIWGIRLDGLDRLLNHFEWARLLIHLAQRRGFKSNRKSELKDTETGKVLSSIQLNEKRLSLYRTVGEMWMKDPDFSKYDRKRNSPNEYVFSVSRAELEKEIVTLFAAQRRFQSPYASKDLQETYLQIWTHQLPFASGNAILNKVGYCSLLKGKERRIPKATYTFQYFSALDQVNRTRLGPDFQPFTKEQREIILNNMFQRTDYYKKKTIPEVTYYDIRKWLELDETIQFKGLNYDPNEELKKIEKKPFINLKAFYEINKVVANYSERTNETFSTLDYDGIGYALTVYKTDKDIRSYLKSSHNLPKRCYDDQLIEELLSLSYTKFGHLSLKAINHVLSIMQKGNTYKEAVDQLGYDTSGLKKEKRSKFLPPISDEITNPIVKRALTQARKVVNAIIRRHGSPHSVHIELARELSKNHDERTKIVSAQDENYKKNKGAISILSEHGILNPTGYDIVRYKLWKEQGERCAYSLKEIPADTFFNELKKERNGAPILEVDHILPYSQSFIDSYHNKVLVYSDENRKKGNRIPYTYFLETNKDWEAFERYVRSNKFFSKKKREYLLKRAYLPRESELIKERHLNDTRYASTFLKNFIEQNLQFKEAEDNPRKRRVQTVNGVITAHFRKRWGLEKDRQETYLHHAMDAIIVACTDHHMVTRVTEYYQIKESNKSVKKPYFPMPWEGFRDELLSHLASQPIAKKISEELKAGYQSLDYIFVSRMPKRSITGAAHKQTIMRKGGIDKKGKTIIIERLHLKDIKFDENGDFKMVGKEQDMATYEAIKQRYLEHGKNSKKAFETPLYKPSKKGTGNLIKRVKVEGQAKSFVREVNGGVAQNGDLVRVDLFEKDDKYYMVPIYVPDTVCSELPKKVVASSKGYEQWLTLDNSFTFKFSLYPYDLVRLVKGDEDRFLYFGTLDIDSDRLNFKDVNKPSKKNEYRYSLKTIEDLEKYEVGVLGDLRLVRKETRRNFHSGGSKRPAATKKAGQAKKKK

SEQ ID NO: 500 - protein, 1321 aa, Artificial Sequence
  source: /note="Description of Artificial Sequence: Synthetic polypeptide"
  source: /note="LPG50152-nAPG07433.1  protein sequence"
MAPKKKRKVDYKDHDGDYKDHDIDYKDDDDKMSDNELNHEYWMRHALGLAKRAREEGEVPVGAVLVLNNQVIGEGWNRAIGLHDPTAHAEIMALRQGGLVLQNYRLTDTTLYVTFEPCVMCAGAMVHSRIGTLVFGVRNSKRGAAGSLMNVLNYPGMNHRVEIVEGILSESCAAMLCDFYRQPRAVKNALKKAADPAASGGSSGGSSGSETPGTSESATPESSGGSSGGSMRELDYRIGLAIGTNSIGWGVIELSWNKDRERYEKVRIVDQGVRMFDRAEMPKTGASLAEPRRIARSSRRRLNRKSQRKKNIRNLLVQHGVITQEELDSLYPLSKKSMDIWGIRLDGLDRLLNHFEWARLLIHLAQRRGFKSNRKSELKDTETGKVLSSIQLNEKRLSLYRTVGEMWMKDPDFSKYDRKRNSPNEYVFSVSRAELEKEIVTLFAAQRRFQSPYASKDLQETYLQIWTHQLPFASGNAILNKVGYCSLLKGKERRIPKATYTFQYFSALDQVNRTRLGPDFQPFTKEQREIILNNMFQRTDYYKKKTIPEVTYYDIRKWLELDETIQFKGLNYDPNEELKKIEKKPFINLKAFYEINKVVANYSERTNETFSTLDYDGIGYALTVYKTDKDIRSYLKSSHNLPKRCYDDQLIEELLSLSYTKFGHLSLKAINHVLSIMQKGNTYKEAVDQLGYDTSGLKKEKRSKFLPPISDEITNPIVKRALTQARKVVNAIIRRHGSPHSVHIELARELSKNHDERTKIVSAQDENYKKNKGAISILSEHGILNPTGYDIVRYKLWKEQGERCAYSLKEIPADTFFNELKKERNGAPILEVDHILPYSQSFIDSYHNKVLVYSDENRKKGNRIPYTYFLETNKDWEAFERYVRSNKFFSKKKREYLLKRAYLPRESELIKERHLNDTRYASTFLKNFIEQNLQFKEAEDNPRKRRVQTVNGVITAHFRKRWGLEKDRQETYLHHAMDAIIVACTDHHMVTRVTEYYQIKESNKSVKKPYFPMPWEGFRDELLSHLASQPIAKKISEELKAGYQSLDYIFVSRMPKRSITGAAHKQTIMRKGGIDKKGKTIIIERLHLKDIKFDENGDFKMVGKEQDMATYEAIKQRYLEHGKNSKKAFETPLYKPSKKGTGNLIKRVKVEGQAKSFVREVNGGVAQNGDLVRVDLFEKDDKYYMVPIYVPDTVCSELPKKVVASSKGYEQWLTLDNSFTFKFSLYPYDLVRLVKGDEDRFLYFGTLDIDSDRLNFKDVNKPSKKNEYRYSLKTIEDLEKYEVGVLGDLRLVRKETRRNFHSGGSKRPAATKKAGQAKKKK

SEQ ID NO: 501 - protein, 1318 aa, Artificial Sequence
  source: /note="Description of Artificial Sequence: Synthetic polypeptide"
  source: /note="LPG50153-nAPG07433.1  protein sequence"
MAPKKKRKVDYKDHDGDYKDHDIDYKDDDDKMSDTEFTHEHWMRHALTLAQRARDEGEVPVGAVLVLNNQVIGEGWNRAIGLHDPTAHAEIMALRQGGLVLQNYRLLDTTLYVTFEPCVMCAGAMVHSRIGHLVFGVRNSKRGAIGSLMNVLGYPGMNHQVQVSEGVLATECSAMLCDFYRAPRLVKNALKEKARSGGSSGGSSGSETPGTSESATPESSGGSSGGSMRELDYRIGLAIGTNSIGWGVIELSWNKDRERYEKVRIVDQGVRMFDRAEMPKTGASLAEPRRIARSSRRRLNRKSQRKKNIRNLLVQHGVITQEELDSLYPLSKKSMDIWGIRLDGLDRLLNHFEWARLLIHLAQRRGFKSNRKSELKDTETGKVLSSIQLNEKRLSLYRTVGEMWMKDPDFSKYDRKRNSPNEYVFSVSRAELEKEIVTLFAAQRRFQSPYASKDLQETYLQIWTHQLPFASGNAILNKVGYCSLLKGKERRIPKATYTFQYFSALDQVNRTRLGPDFQPFTKEQREIILNNMFQRTDYYKKKTIPEVTYYDIRKWLELDETIQFKGLNYDPNEELKKIEKKPFINLKAFYEINKVVANYSERTNETFSTLDYDGIGYALTVYKTDKDIRSYLKSSHNLPKRCYDDQLIEELLSLSYTKFGHLSLKAINHVLSIMQKGNTYKEAVDQLGYDTSGLKKEKRSKFLPPISDEITNPIVKRALTQARKVVNAIIRRHGSPHSVHIELARELSKNHDERTKIVSAQDENYKKNKGAISILSEHGILNPTGYDIVRYKLWKEQGERCAYSLKEIPADTFFNELKKERNGAPILEVDHILPYSQSFIDSYHNKVLVYSDENRKKGNRIPYTYFLETNKDWEAFERYVRSNKFFSKKKREYLLKRAYLPRESELIKERHLNDTRYASTFLKNFIEQNLQFKEAEDNPRKRRVQTVNGVITAHFRKRWGLEKDRQETYLHHAMDAIIVACTDHHMVTRVTEYYQIKESNKSVKKPYFPMPWEGFRDELLSHLASQPIAKKISEELKAGYQSLDYIFVSRMPKRSITGAAHKQTIMRKGGIDKKGKTIIIERLHLKDIKFDENGDFKMVGKEQDMATYEAIKQRYLEHGKNSKKAFETPLYKPSKKGTGNLIKRVKVEGQAKSFVREVNGGVAQNGDLVRVDLFEKDDKYYMVPIYVPDTVCSELPKKVVASSKGYEQWLTLDNSFTFKFSLYPYDLVRLVKGDEDRFLYFGTLDIDSDRLNFKDVNKPSKKNEYRYSLKTIEDLEKYEVGVLGDLRLVRKETRRNFHSGGSKRPAATKKAGQAKKKK

SEQ ID NO: 502 - protein, 1325 aa, Artificial Sequence
  source: /note="Description of Artificial Sequence: Synthetic polypeptide"
  source: /note="LPG50154-nAPG07433.1  protein sequence"
MAPKKKRKVDYKDHDGDYKDHDIDYKDDDDKMSESEFTHEHWMRHALTLARRAREEGEVPVGAVLVLNNQVIGEGWNRAIGLHDPTAHAEIMALRQGGLVLQNYRLLDSTLYVTFEPCVMCAGAMVHGRIGNLVFGVRNSKRGAIGSLMNVVGYPGMNHQINVIEGVLAEECSAMLCDFYRAPRLVKNALKEKARNGNNPNKSGGSSGGSSGSETPGTSESATPESSGGSSGGSMRELDYRIGLAIGTNSIGWGVIELSWNKDRERYEKVRIVDQGVRMFDRAEMPKTGASLAEPRRIARSSRRRLNRKSQRKKNIRNLLVQHGVITQEELDSLYPLSKKSMDIWGIRLDGLDRLLNHFEWARLLIHLAQRRGFKSNRKSELKDTETGKVLSSIQLNEKRLSLYRTVGEMWMKDPDFSKYDRKRNSPNEYVFSVSRAELEKEIVTLFAAQRRFQSPYASKDLQETYLQIWTHQLPFASGNAILNKVGYCSLLKGKERRIPKATYTFQYFSALDQVNRTRLGPDFQPFTKEQREIILNNMFQRTDYYKKKTIPEVTYYDIRKWLELDETIQFKGLNYDPNEELKKIEKKPFINLKAFYEINKVVANYSERTNETFSTLDYDGIGYALTVYKTDKDIRSYLKSSHNLPKRCYDDQLIEELLSLSYTKFGHLSLKAINHVLSIMQKGNTYKEAVDQLGYDTSGLKKEKRSKFLPPISDEITNPIVKRALTQARKVVNAIIRRHGSPHSVHIELARELSKNHDERTKIVSAQDENYKKNKGAISILSEHGILNPTGYDIVRYKLWKEQGERCAYSLKEIPADTFFNELKKERNGAPILEVDHILPYSQSFIDSYHNKVLVYSDENRKKGNRIPYTYFLETNKDWEAFERYVRSNKFFSKKKREYLLKRAYLPRESELIKERHLNDTRYASTFLKNFIEQNLQFKEAEDNPRKRRVQTVNGVITAHFRKRWGLEKDRQETYLHHAMDAIIVACTDHHMVTRVTEYYQIKESNKSVKKPYFPMPWEGFRDELLSHLASQPIAKKISEELKAGYQSLDYIFVSRMPKRSITGAAHKQTIMRKGGIDKKGKTIIIERLHLKDIKFDENGDFKMVGKEQDMATYEAIKQRYLEHGKNSKKAFETPLYKPSKKGTGNLIKRVKVEGQAKSFVREVNGGVAQNGDLVRVDLFEKDDKYYMVPIYVPDTVCSELPKKVVASSKGYEQWLTLDNSFTFKFSLYPYDLVRLVKGDEDRFLYFGTLDIDSDRLNFKDVNKPSKKNEYRYSLKTIEDLEKYEVGVLGDLRLVRKETRRNFHSGGSKRPAATKKAGQAKKKK

SEQ ID NO: 503 - protein, 1318 aa, Artificial Sequence
  source: /note="Description of Artificial Sequence: Synthetic polypeptide"
  source: /note="LPG50155-nAPG07433.1  protein sequence"
MAPKKKRKVDYKDHDGDYKDHDIDYKDDDDKMSNPELTHEHWMRYALTLAKRAREEGEVPVGAVLVLNNQVIGEGWNRAIGLHDPTAHAEIMALRQGGLVLQNYRLIDTTLYVTFEPCVMCAGAMVHSRIGQLVFGVRNSKRGAAGSLMNVLNYPGMNHRIEFTEGVLRDECAAMLCDFYRQPRLVKNALKTGNASGGSSGGSSGSETPGTSESATPESSGGSSGGSMRELDYRIGLAIGTNSIGWGVIELSWNKDRERYEKVRIVDQGVRMFDRAEMPKTGASLAEPRRIARSSRRRLNRKSQRKKNIRNLLVQHGVITQEELDSLYPLSKKSMDIWGIRLDGLDRLLNHFEWARLLIHLAQRRGFKSNRKSELKDTETGKVLSSIQLNEKRLSLYRTVGEMWMKDPDFSKYDRKRNSPNEYVFSVSRAELEKEIVTLFAAQRRFQSPYASKDLQETYLQIWTHQLPFASGNAILNKVGYCSLLKGKERRIPKATYTFQYFSALDQVNRTRLGPDFQPFTKEQREIILNNMFQRTDYYKKKTIPEVTYYDIRKWLELDETIQFKGLNYDPNEELKKIEKKPFINLKAFYEINKVVANYSERTNETFSTLDYDGIGYALTVYKTDKDIRSYLKSSHNLPKRCYDDQLIEELLSLSYTKFGHLSLKAINHVLSIMQKGNTYKEAVDQLGYDTSGLKKEKRSKFLPPISDEITNPIVKRALTQARKVVNAIIRRHGSPHSVHIELARELSKNHDERTKIVSAQDENYKKNKGAISILSEHGILNPTGYDIVRYKLWKEQGERCAYSLKEIPADTFFNELKKERNGAPILEVDHILPYSQSFIDSYHNKVLVYSDENRKKGNRIPYTYFLETNKDWEAFERYVRSNKFFSKKKREYLLKRAYLPRESELIKERHLNDTRYASTFLKNFIEQNLQFKEAEDNPRKRRVQTVNGVITAHFRKRWGLEKDRQETYLHHAMDAIIVACTDHHMVTRVTEYYQIKESNKSVKKPYFPMPWEGFRDELLSHLASQPIAKKISEELKAGYQSLDYIFVSRMPKRSITGAAHKQTIMRKGGIDKKGKTIIIERLHLKDIKFDENGDFKMVGKEQDMATYEAIKQRYLEHGKNSKKAFETPLYKPSKKGTGNLIKRVKVEGQAKSFVREVNGGVAQNGDLVRVDLFEKDDKYYMVPIYVPDTVCSELPKKVVASSKGYEQWLTLDNSFTFKFSLYPYDLVRLVKGDEDRFLYFGTLDIDSDRLNFKDVNKPSKKNEYRYSLKTIEDLEKYEVGVLGDLRLVRKETRRNFHSGGSKRPAATKKAGQAKKKK

SEQ ID NO: 504 - protein, 1320 aa, Artificial Sequence
  source: /note="Description of Artificial Sequence: Synthetic polypeptide"
  source: /note="LPG50156-nAPG07433.1  protein sequence"
MAPKKKRKVDYKDHDGDYKDHDIDYKDDDDKMSDPELNHEYWMRHALQLAKRAREEGEVPVGAVLVLNNQVIGEGWNRAIGLHDPTAHAEIMALRQGGLVLQNYRLLDTTLYVTFEPCVMCSGAMIHSRIGTVVFGVRNEKRGAAGSLLNVLRYPGMNHQVNVLGGVLAPACSEMLCEFYRMPRQQKNRQKAESKLSSGGSSGGSSGSETPGTSESATPESSGGSSGGSMRELDYRIGLAIGTNSIGWGVIELSWNKDRERYEKVRIVDQGVRMFDRAEMPKTGASLAEPRRIARSSRRRLNRKSQRKKNIRNLLVQHGVITQEELDSLYPLSKKSMDIWGIRLDGLDRLLNHFEWARLLIHLAQRRGFKSNRKSELKDTETGKVLSSIQLNEKRLSLYRTVGEMWMKDPDFSKYDRKRNSPNEYVFSVSRAELEKEIVTLFAAQRRFQSPYASKDLQETYLQIWTHQLPFASGNAILNKVGYCSLLKGKERRIPKATYTFQYFSALDQVNRTRLGPDFQPFTKEQREIILNNMFQRTDYYKKKTIPEVTYYDIRKWLELDETIQFKGLNYDPNEELKKIEKKPFINLKAFYEINKVVANYSERTNETFSTLDYDGIGYALTVYKTDKDIRSYLKSSHNLPKRCYDDQLIEELLSLSYTKFGHLSLKAINHVLSIMQKGNTYKEAVDQLGYDTSGLKKEKRSKFLPPISDEITNPIVKRALTQARKVVNAIIRRHGSPHSVHIELARELSKNHDERTKIVSAQDENYKKNKGAISILSEHGILNPTGYDIVRYKLWKEQGERCAYSLKEIPADTFFNELKKERNGAPILEVDHILPYSQSFIDSYHNKVLVYSDENRKKGNRIPYTYFLETNKDWEAFERYVRSNKFFSKKKREYLLKRAYLPRESELIKERHLNDTRYASTFLKNFIEQNLQFKEAEDNPRKRRVQTVNGVITAHFRKRWGLEKDRQETYLHHAMDAIIVACTDHHMVTRVTEYYQIKESNKSVKKPYFPMPWEGFRDELLSHLASQPIAKKISEELKAGYQSLDYIFVSRMPKRSITGAAHKQTIMRKGGIDKKGKTIIIERLHLKDIKFDENGDFKMVGKEQDMATYEAIKQRYLEHGKNSKKAFETPLYKPSKKGTGNLIKRVKVEGQAKSFVREVNGGVAQNGDLVRVDLFEKDDKYYMVPIYVPDTVCSELPKKVVASSKGYEQWLTLDNSFTFKFSLYPYDLVRLVKGDEDRFLYFGTLDIDSDRLNFKDVNKPSKKNEYRYSLKTIEDLEKYEVGVLGDLRLVRKETRRNFHSGGSKRPAATKKAGQAKKKK

SEQ ID NO: 505 - protein, 1320 aa, Artificial Sequence
  source: /note="Description of Artificial Sequence: Synthetic polypeptide"
  source: /note="LPG50157-nAPG07433.1  protein sequence"
MAPKKKRKVDYKDHDGDYKDHDIDYKDDDDKMSDNELNHEHWMRHALTLAQRAREEGEVPVGAVLVLQNQVIGEGWNRAIGLHDPTAHAEIMALRQGGMVLQNYRLIDTTLYVTFEPCVMCAGAMVHSRIGQLVFGVRNSKRGAAGSLINVLNYPGMNHRVEITEGVLADDCSSMLCDFYRHPREQKNALKRAAHSNSGGSSGGSSGSETPGTSESATPESSGGSSGGSMRELDYRIGLAIGTNSIGWGVIELSWNKDRERYEKVRIVDQGVRMFDRAEMPKTGASLAEPRRIARSSRRRLNRKSQRKKNIRNLLVQHGVITQEELDSLYPLSKKSMDIWGIRLDGLDRLLNHFEWARLLIHLAQRRGFKSNRKSELKDTETGKVLSSIQLNEKRLSLYRTVGEMWMKDPDFSKYDRKRNSPNEYVFSVSRAELEKEIVTLFAAQRRFQSPYASKDLQETYLQIWTHQLPFASGNAILNKVGYCSLLKGKERRIPKATYTFQYFSALDQVNRTRLGPDFQPFTKEQREIILNNMFQRTDYYKKKTIPEVTYYDIRKWLELDETIQFKGLNYDPNEELKKIEKKPFINLKAFYEINKVVANYSERTNETFSTLDYDGIGYALTVYKTDKDIRSYLKSSHNLPKRCYDDQLIEELLSLSYTKFGHLSLKAINHVLSIMQKGNTYKEAVDQLGYDTSGLKKEKRSKFLPPISDEITNPIVKRALTQARKVVNAIIRRHGSPHSVHIELARELSKNHDERTKIVSAQDENYKKNKGAISILSEHGILNPTGYDIVRYKLWKEQGERCAYSLKEIPADTFFNELKKERNGAPILEVDHILPYSQSFIDSYHNKVLVYSDENRKKGNRIPYTYFLETNKDWEAFERYVRSNKFFSKKKREYLLKRAYLPRESELIKERHLNDTRYASTFLKNFIEQNLQFKEAEDNPRKRRVQTVNGVITAHFRKRWGLEKDRQETYLHHAMDAIIVACTDHHMVTRVTEYYQIKESNKSVKKPYFPMPWEGFRDELLSHLASQPIAKKISEELKAGYQSLDYIFVSRMPKRSITGAAHKQTIMRKGGIDKKGKTIIIERLHLKDIKFDENGDFKMVGKEQDMATYEAIKQRYLEHGKNSKKAFETPLYKPSKKGTGNLIKRVKVEGQAKSFVREVNGGVAQNGDLVRVDLFEKDDKYYMVPIYVPDTVCSELPKKVVASSKGYEQWLTLDNSFTFKFSLYPYDLVRLVKGDEDRFLYFGTLDIDSDRLNFKDVNKPSKKNEYRYSLKTIEDLEKYEVGVLGDLRLVRKETRRNFHSGGSKRPAATKKAGQAKKKK

SEQ ID NO: 506 - protein, 1322 aa, Artificial Sequence
  source: /note="Description of Artificial Sequence: Synthetic polypeptide"
  source: /note="LPG50158-nAPG07433.1  protein sequence"
MAPKKKRKVDYKDHDGDYKDHDIDYKDDDDKMSNPEHNHEYWMRHALTLAQRARDEGEVPVGAVLVYNNQVIGEGWNRAIGLHDPTAHAEIMALRQGGLVLQNYRLLDTTLYVTFEPCVMCSGAMVHSRIGTLVFGVRNEKRGAAGSLMNVLGYPGMNHQVQTIGGVLAPECSGLLCDFYRMPRQQKNQQKAELNQPGDSGGSSGGSSGSETPGTSESATPESSGGSSGGSMRELDYRIGLAIGTNSIGWGVIELSWNKDRERYEKVRIVDQGVRMFDRAEMPKTGASLAEPRRIARSSRRRLNRKSQRKKNIRNLLVQHGVITQEELDSLYPLSKKSMDIWGIRLDGLDRLLNHFEWARLLIHLAQRRGFKSNRKSELKDTETGKVLSSIQLNEKRLSLYRTVGEMWMKDPDFSKYDRKRNSPNEYVFSVSRAELEKEIVTLFAAQRRFQSPYASKDLQETYLQIWTHQLPFASGNAILNKVGYCSLLKGKERRIPKATYTFQYFSALDQVNRTRLGPDFQPFTKEQREIILNNMFQRTDYYKKKTIPEVTYYDIRKWLELDETIQFKGLNYDPNEELKKIEKKPFINLKAFYEINKVVANYSERTNETFSTLDYDGIGYALTVYKTDKDIRSYLKSSHNLPKRCYDDQLIEELLSLSYTKFGHLSLKAINHVLSIMQKGNTYKEAVDQLGYDTSGLKKEKRSKFLPPISDEITNPIVKRALTQARKVVNAIIRRHGSPHSVHIELARELSKNHDERTKIVSAQDENYKKNKGAISILSEHGILNPTGYDIVRYKLWKEQGERCAYSLKEIPADTFFNELKKERNGAPILEVDHILPYSQSFIDSYHNKVLVYSDENRKKGNRIPYTYFLETNKDWEAFERYVRSNKFFSKKKREYLLKRAYLPRESELIKERHLNDTRYASTFLKNFIEQNLQFKEAEDNPRKRRVQTVNGVITAHFRKRWGLEKDRQETYLHHAMDAIIVACTDHHMVTRVTEYYQIKESNKSVKKPYFPMPWEGFRDELLSHLASQPIAKKISEELKAGYQSLDYIFVSRMPKRSITGAAHKQTIMRKGGIDKKGKTIIIERLHLKDIKFDENGDFKMVGKEQDMATYEAIKQRYLEHGKNSKKAFETPLYKPSKKGTGNLIKRVKVEGQAKSFVREVNGGVAQNGDLVRVDLFEKDDKYYMVPIYVPDTVCSELPKKVVASSKGYEQWLTLDNSFTFKFSLYPYDLVRLVKGDEDRFLYFGTLDIDSDRLNFKDVNKPSKKNEYRYSLKTIEDLEKYEVGVLGDLRLVRKETRRNFHSGGSKRPAATKKAGQAKKKK

SEQ ID NO: 507 - protein, 1322 aa, Artificial Sequence
  source: /note="Description of Artificial Sequence: Synthetic polypeptide"
  source: /note="LPG50159-nAPG07433.1  protein sequence"
MAPKKKRKVDYKDHDGDYKDHDIDYKDDDDKMSDLELNHEYWMRHALSLAKRARDEGEVPVGAVLVLNNQVIGEGWNRAIGLHDPTAHAEIMALRQGGLVLQNYRLLDTTLYVTFEPCVMCSGAMVHSRIGTLVYGVRNEKRGAAGSLMNVLGYPGMNHQVQIIGGVLAPDCSGLLCDFYRMPRQQKNQQKAELKSSGDSGGSSGGSSGSETPGTSESATPESSGGSSGGSMRELDYRIGLAIGTNSIGWGVIELSWNKDRERYEKVRIVDQGVRMFDRAEMPKTGASLAEPRRIARSSRRRLNRKSQRKKNIRNLLVQHGVITQEELDSLYPLSKKSMDIWGIRLDGLDRLLNHFEWARLLIHLAQRRGFKSNRKSELKDTETGKVLSSIQLNEKRLSLYRTVGEMWMKDPDFSKYDRKRNSPNEYVFSVSRAELEKEIVTLFAAQRRFQSPYASKDLQETYLQIWTHQLPFASGNAILNKVGYCSLLKGKERRIPKATYTFQYFSALDQVNRTRLGPDFQPFTKEQREIILNNMFQRTDYYKKKTIPEVTYYDIRKWLELDETIQFKGLNYDPNEELKKIEKKPFINLKAFYEINKVVANYSERTNETFSTLDYDGIGYALTVYKTDKDIRSYLKSSHNLPKRCYDDQLIEELLSLSYTKFGHLSLKAINHVLSIMQKGNTYKEAVDQLGYDTSGLKKEKRSKFLPPISDEITNPIVKRALTQARKVVNAIIRRHGSPHSVHIELARELSKNHDERTKIVSAQDENYKKNKGAISILSEHGILNPTGYDIVRYKLWKEQGERCAYSLKEIPADTFFNELKKERNGAPILEVDHILPYSQSFIDSYHNKVLVYSDENRKKGNRIPYTYFLETNKDWEAFERYVRSNKFFSKKKREYLLKRAYLPRESELIKERHLNDTRYASTFLKNFIEQNLQFKEAEDNPRKRRVQTVNGVITAHFRKRWGLEKDRQETYLHHAMDAIIVACTDHHMVTRVTEYYQIKESNKSVKKPYFPMPWEGFRDELLSHLASQPIAKKISEELKAGYQSLDYIFVSRMPKRSITGAAHKQTIMRKGGIDKKGKTIIIERLHLKDIKFDENGDFKMVGKEQDMATYEAIKQRYLEHGKNSKKAFETPLYKPSKKGTGNLIKRVKVEGQAKSFVREVNGGVAQNGDLVRVDLFEKDDKYYMVPIYVPDTVCSELPKKVVASSKGYEQWLTLDNSFTFKFSLYPYDLVRLVKGDEDRFLYFGTLDIDSDRLNFKDVNKPSKKNEYRYSLKTIEDLEKYEVGVLGDLRLVRKETRRNFHSGGSKRPAATKKAGQAKKKK

SEQ ID NO: 508 - protein, 1320 aa, Artificial Sequence
  source: /note="Description of Artificial Sequence: Synthetic polypeptide"
  source: /note="LPG50160-nAPG07433.1  protein sequence"
MAPKKKRKVDYKDHDGDYKDHDIDYKDDDDKMSDHEFNDEYWMRHALTLAKRAREEGEVPVGAVLVLNNQVIGEGWNRAIGLHDPTAHAEIMALRQGGLVLQNYRLIDATLYVTFEPCVMCAGAMVHSRISRLVFGVRNSKRGAAGSLINVLNYPGMNHRVEITEGILAESCSAMLCDFYRWPREVKNALKKARQEESGGSSGGSSGSETPGTSESATPESSGGSSGGSMRELDYRIGLAIGTNSIGWGVIELSWNKDRERYEKVRIVDQGVRMFDRAEMPKTGASLAEPRRIARSSRRRLNRKSQRKKNIRNLLVQHGVITQEELDSLYPLSKKSMDIWGIRLDGLDRLLNHFEWARLLIHLAQRRGFKSNRKSELKDTETGKVLSSIQLNEKRLSLYRTVGEMWMKDPDFSKYDRKRNSPNEYVFSVSRAELEKEIVTLFAAQRRFQSPYASKDLQETYLQIWTHQLPFASGNAILNKVGYCSLLKGKERRIPKATYTFQYFSALDQVNRTRLGPDFQPFTKEQREIILNNMFQRTDYYKKKTIPEVTYYDIRKWLELDETIQFKGLNYDPNEELKKIEKKPFINLKAFYEINKVVANYSERTNETFSTLDYDGIGYALTVYKTDKDIRSYLKSSHNLPKRCYDDQLIEELLSLSYTKFGHLSLKAINHVLSIMQKGNTYKEAVDQLGYDTSGLKKEKRSKFLPPISDEITNPIVKRALTQARKVVNAIIRRHGSPHSVHIELARELSKNHDERTKIVSAQDENYKKNKGAISILSEHGILNPTGYDIVRYKLWKEQGERCAYSLKEIPADTFFNELKKERNGAPILEVDHILPYSQSFIDSYHNKVLVYSDENRKKGNRIPYTYFLETNKDWEAFERYVRSNKFFSKKKREYLLKRAYLPRESELIKERHLNDTRYASTFLKNFIEQNLQFKEAEDNPRKRRVQTVNGVITAHFRKRWGLEKDRQETYLHHAMDAIIVACTDHHMVTRVTEYYQIKESNKSVKKPYFPMPWEGFRDELLSHLASQPIAKKISEELKAGYQSLDYIFVSRMPKRSITGAAHKQTIMRKGGIDKKGKTIIIERLHLKDIKFDENGDFKMVGKEQDMATYEAIKQRYLEHGKNSKKAFETPLYKPSKKGTGNLIKRVKVEGQAKSFVREVNGGVAQNGDLVRVDLFEKDDKYYMVPIYVPDTVCSELPKKVVASSKGYEQWLTLDNSFTFKFSLYPYDLVRLVKGDEDRFLYFGTLDIDSDRLNFKDVNKPSKKNEYRYSLKTIEDLEKYEVGVLGDLRLVRKETRRNFHSGGSKRPAATKKAGQAKKKK

SEQ ID NO: 509 - protein, 1320 aa, Artificial Sequence
  source: /note="Description of Artificial Sequence: Synthetic polypeptide"
  source: /note="LPG50161-nAPG07433.1  protein sequence"
MAPKKKRKVDYKDHDGDYKDHDIDYKDDDDKMSQTELTHEYWMRHALTLAQRARDEGEVPVGAVLVLNNQVIGEGWNRAIGLHDPTAHAEIMALRQGGLVLQNYRLLDTTLYVTFEPCVMCAGAMVHGRIGTLVFGVRNSKRGAVGSLMNITGYPGMNHQVQVIEGILATECSAMLCAFYRQPRLVKNALKEAAKTASGGSSGGSSGSETPGTSESATPESSGGSSGGSMRELDYRIGLAIGTNSIGWGVIELSWNKDRERYEKVRIVDQGVRMFDRAEMPKTGASLAEPRRIARSSRRRLNRKSQRKKNIRNLLVQHGVITQEELDSLYPLSKKSMDIWGIRLDGLDRLLNHFEWARLLIHLAQRRGFKSNRKSELKDTETGKVLSSIQLNEKRLSLYRTVGEMWMKDPDFSKYDRKRNSPNEYVFSVSRAELEKEIVTLFAAQRRFQSPYASKDLQETYLQIWTHQLPFASGNAILNKVGYCSLLKGKERRIPKATYTFQYFSALDQVNRTRLGPDFQPFTKEQREIILNNMFQRTDYYKKKTIPEVTYYDIRKWLELDETIQFKGLNYDPNEELKKIEKKPFINLKAFYEINKVVANYSERTNETFSTLDYDGIGYALTVYKTDKDIRSYLKSSHNLPKRCYDDQLIEELLSLSYTKFGHLSLKAINHVLSIMQKGNTYKEAVDQLGYDTSGLKKEKRSKFLPPISDEITNPIVKRALTQARKVVNAIIRRHGSPHSVHIELARELSKNHDERTKIVSAQDENYKKNKGAISILSEHGILNPTGYDIVRYKLWKEQGERCAYSLKEIPADTFFNELKKERNGAPILEVDHILPYSQSFIDSYHNKVLVYSDENRKKGNRIPYTYFLETNKDWEAFERYVRSNKFFSKKKREYLLKRAYLPRESELIKERHLNDTRYASTFLKNFIEQNLQFKEAEDNPRKRRVQTVNGVITAHFRKRWGLEKDRQETYLHHAMDAIIVACTDHHMVTRVTEYYQIKESNKSVKKPYFPMPWEGFRDELLSHLASQPIAKKISEELKAGYQSLDYIFVSRMPKRSITGAAHKQTIMRKGGIDKKGKTIIIERLHLKDIKFDENGDFKMVGKEQDMATYEAIKQRYLEHGKNSKKAFETPLYKPSKKGTGNLIKRVKVEGQAKSFVREVNGGVAQNGDLVRVDLFEKDDKYYMVPIYVPDTVCSELPKKVVASSKGYEQWLTLDNSFTFKFSLYPYDLVRLVKGDEDRFLYFGTLDIDSDRLNFKDVNKPSKKNEYRYSLKTIEDLEKYEVGVLGDLRLVRKETRRNFHSGGSKRPAATKKAGQAKKKK

SEQ ID NO: 510 - protein, 1321 aa, Artificial Sequence
  source: /note="Description of Artificial Sequence: Synthetic polypeptide"
  source: /note="LPG50162-nAPG07433.1  protein sequence"
MAPKKKRKVDYKDHDGDYKDHDIDYKDDDDKMSNPELNHDYWMRHALSLAKRAREEGEVPVGAVLVRNNEVIGEGWNRAIGLHDPTAHAEIMALRQGGMVLQNYRLIDTTLYVTFEPCVMCAGAMVHSRIGQLVFGVRNSKRGAAGSLMNVLNYPGMNHRVEIVEGVLRDECAGMLCDFYRQPRLVKNAQKKGAEPLISGGSSGGSSGSETPGTSESATPESSGGSSGGSMRELDYRIGLAIGTNSIGWGVIELSWNKDRERYEKVRIVDQGVRMFDRAEMPKTGASLAEPRRIARSSRRRLNRKSQRKKNIRNLLVQHGVITQEELDSLYPLSKKSMDIWGIRLDGLDRLLNHFEWARLLIHLAQRRGFKSNRKSELKDTETGKVLSSIQLNEKRLSLYRTVGEMWMKDPDFSKYDRKRNSPNEYVFSVSRAELEKEIVTLFAAQRRFQSPYASKDLQETYLQIWTHQLPFASGNAILNKVGYCSLLKGKERRIPKATYTFQYFSALDQVNRTRLGPDFQPFTKEQREIILNNMFQRTDYYKKKTIPEVTYYDIRKWLELDETIQFKGLNYDPNEELKKIEKKPFINLKAFYEINKVVANYSERTNETFSTLDYDGIGYALTVYKTDKDIRSYLKSSHNLPKRCYDDQLIEELLSLSYTKFGHLSLKAINHVLSIMQKGNTYKEAVDQLGYDTSGLKKEKRSKFLPPISDEITNPIVKRALTQARKVVNAIIRRHGSPHSVHIELARELSKNHDERTKIVSAQDENYKKNKGAISILSEHGILNPTGYDIVRYKLWKEQGERCAYSLKEIPADTFFNELKKERNGAPILEVDHILPYSQSFIDSYHNKVLVYSDENRKKGNRIPYTYFLETNKDWEAFERYVRSNKFFSKKKREYLLKRAYLPRESELIKERHLNDTRYASTFLKNFIEQNLQFKEAEDNPRKRRVQTVNGVITAHFRKRWGLEKDRQETYLHHAMDAIIVACTDHHMVTRVTEYYQIKESNKSVKKPYFPMPWEGFRDELLSHLASQPIAKKISEELKAGYQSLDYIFVSRMPKRSITGAAHKQTIMRKGGIDKKGKTIIIERLHLKDIKFDENGDFKMVGKEQDMATYEAIKQRYLEHGKNSKKAFETPLYKPSKKGTGNLIKRVKVEGQAKSFVREVNGGVAQNGDLVRVDLFEKDDKYYMVPIYVPDTVCSELPKKVVASSKGYEQWLTLDNSFTFKFSLYPYDLVRLVKGDEDRFLYFGTLDIDSDRLNFKDVNKPSKKNEYRYSLKTIEDLEKYEVGVLGDLRLVRKETRRNFHSGGSKRPAATKKAGQAKKKK

SEQ ID NO: 511 - protein, 1326 aa, Artificial Sequence
  source: /note="Description of Artificial Sequence: Synthetic polypeptide"
  source: /note="LPG50163-nAPG07433.1  protein sequence"
MAPKKKRKVDYKDHDGDYKDHDIDYKDDDDKMSNPELNHEYWMRYALTLAKRARDEGEVPVGAVLVYNDQVIGEGWNRAIGLHDPTAHAEIMALRQGGLVLQNYRLIDTTLYVTFEPCVMCAGAMVHSRIGRLVFGVRNSKRGAAGSLLNVLNYPGMNHHIEMEEGVLRDECAAMLCDFYRQPRMVKNALKKSPPDSPNLQARSGGSSGGSSGSETPGTSESATPESSGGSSGGSMRELDYRIGLAIGTNSIGWGVIELSWNKDRERYEKVRIVDQGVRMFDRAEMPKTGASLAEPRRIARSSRRRLNRKSQRKKNIRNLLVQHGVITQEELDSLYPLSKKSMDIWGIRLDGLDRLLNHFEWARLLIHLAQRRGFKSNRKSELKDTETGKVLSSIQLNEKRLSLYRTVGEMWMKDPDFSKYDRKRNSPNEYVFSVSRAELEKEIVTLFAAQRRFQSPYASKDLQETYLQIWTHQLPFASGNAILNKVGYCSLLKGKERRIPKATYTFQYFSALDQVNRTRLGPDFQPFTKEQREIILNNMFQRTDYYKKKTIPEVTYYDIRKWLELDETIQFKGLNYDPNEELKKIEKKPFINLKAFYEINKVVANYSERTNETFSTLDYDGIGYALTVYKTDKDIRSYLKSSHNLPKRCYDDQLIEELLSLSYTKFGHLSLKAINHVLSIMQKGNTYKEAVDQLGYDTSGLKKEKRSKFLPPISDEITNPIVKRALTQARKVVNAIIRRHGSPHSVHIELARELSKNHDERTKIVSAQDENYKKNKGAISILSEHGILNPTGYDIVRYKLWKEQGERCAYSLKEIPADTFFNELKKERNGAPILEVDHILPYSQSFIDSYHNKVLVYSDENRKKGNRIPYTYFLETNKDWEAFERYVRSNKFFSKKKREYLLKRAYLPRESELIKERHLNDTRYASTFLKNFIEQNLQFKEAEDNPRKRRVQTVNGVITAHFRKRWGLEKDRQETYLHHAMDAIIVACTDHHMVTRVTEYYQIKESNKSVKKPYFPMPWEGFRDELLSHLASQPIAKKISEELKAGYQSLDYIFVSRMPKRSITGAAHKQTIMRKGGIDKKGKTIIIERLHLKDIKFDENGDFKMVGKEQDMATYEAIKQRYLEHGKNSKKAFETPLYKPSKKGTGNLIKRVKVEGQAKSFVREVNGGVAQNGDLVRVDLFEKDDKYYMVPIYVPDTVCSELPKKVVASSKGYEQWLTLDNSFTFKFSLYPYDLVRLVKGDEDRFLYFGTLDIDSDRLNFKDVNKPSKKNEYRYSLKTIEDLEKYEVGVLGDLRLVRKETRRNFHSGGSKRPAATKKAGQAKKKK

SEQ ID NO: 512 - protein, 1322 aa, Artificial Sequence
  source: /note="Description of Artificial Sequence: Synthetic polypeptide"
  source: /note="LPG50164-nAPG07433.1  protein sequence"
MAPKKKRKVDYKDHDGDYKDHDIDYKDDDDKMSNPEFTHEYWMRHALTLARRARDEGEVPVGAVLVLNNQVIGEGWNRAIGLHDPTAHAEIMALRQGGLVLQNYRLLDTTLYVTFEPCVMCSGAMVHSRIGTLVFGVRNEKRGAAGSLMNVLGYPGMNHQVKTIGGVLAPECSGLLCDFYRMPRQQKNQQKAELKSSGDSGGSSGGSSGSETPGTSESATPESSGGSSGGSMRELDYRIGLAIGTNSIGWGVIELSWNKDRERYEKVRIVDQGVRMFDRAEMPKTGASLAEPRRIARSSRRRLNRKSQRKKNIRNLLVQHGVITQEELDSLYPLSKKSMDIWGIRLDGLDRLLNHFEWARLLIHLAQRRGFKSNRKSELKDTETGKVLSSIQLNEKRLSLYRTVGEMWMKDPDFSKYDRKRNSPNEYVFSVSRAELEKEIVTLFAAQRRFQSPYASKDLQETYLQIWTHQLPFASGNAILNKVGYCSLLKGKERRIPKATYTFQYFSALDQVNRTRLGPDFQPFTKEQREIILNNMFQRTDYYKKKTIPEVTYYDIRKWLELDETIQFKGLNYDPNEELKKIEKKPFINLKAFYEINKVVANYSERTNETFSTLDYDGIGYALTVYKTDKDIRSYLKSSHNLPKRCYDDQLIEELLSLSYTKFGHLSLKAINHVLSIMQKGNTYKEAVDQLGYDTSGLKKEKRSKFLPPISDEITNPIVKRALTQARKVVNAIIRRHGSPHSVHIELARELSKNHDERTKIVSAQDENYKKNKGAISILSEHGILNPTGYDIVRYKLWKEQGERCAYSLKEIPADTFFNELKKERNGAPILEVDHILPYSQSFIDSYHNKVLVYSDENRKKGNRIPYTYFLETNKDWEAFERYVRSNKFFSKKKREYLLKRAYLPRESELIKERHLNDTRYASTFLKNFIEQNLQFKEAEDNPRKRRVQTVNGVITAHFRKRWGLEKDRQETYLHHAMDAIIVACTDHHMVTRVTEYYQIKESNKSVKKPYFPMPWEGFRDELLSHLASQPIAKKISEELKAGYQSLDYIFVSRMPKRSITGAAHKQTIMRKGGIDKKGKTIIIERLHLKDIKFDENGDFKMVGKEQDMATYEAIKQRYLEHGKNSKKAFETPLYKPSKKGTGNLIKRVKVEGQAKSFVREVNGGVAQNGDLVRVDLFEKDDKYYMVPIYVPDTVCSELPKKVVASSKGYEQWLTLDNSFTFKFSLYPYDLVRLVKGDEDRFLYFGTLDIDSDRLNFKDVNKPSKKNEYRYSLKTIEDLEKYEVGVLGDLRLVRKETRRNFHSGGSKRPAATKKAGQAKKKK

SEQ ID NO: 513 - protein, 1319 aa, Artificial Sequence
  source: /note="Description of Artificial Sequence: Synthetic polypeptide"
  source: /note="LPG50165-nAPG07433.1  protein sequence"
MAPKKKRKVDYKDHDGDYKDHDIDYKDDDDKMSDNEFNHEYWMRHALTLAQRARDEGEVPVGAVLVLDNQVIGEGWNRAIGLHDPTAHAEIMALRQGGMVLQNYRLINATLYVTFEPCVMCAGAMVHSRIGHVVFGVRNSKRGAAGSLMNVLNYPGMNHRVEVTEGVLREQCAGMLCDFYREPREQFNALRKAQKASGGSSGGSSGSETPGTSESATPESSGGSSGGSMRELDYRIGLAIGTNSIGWGVIELSWNKDRERYEKVRIVDQGVRMFDRAEMPKTGASLAEPRRIARSSRRRLNRKSQRKKNIRNLLVQHGVITQEELDSLYPLSKKSMDIWGIRLDGLDRLLNHFEWARLLIHLAQRRGFKSNRKSELKDTETGKVLSSIQLNEKRLSLYRTVGEMWMKDPDFSKYDRKRNSPNEYVFSVSRAELEKEIVTLFAAQRRFQSPYASKDLQETYLQIWTHQLPFASGNAILNKVGYCSLLKGKERRIPKATYTFQYFSALDQVNRTRLGPDFQPFTKEQREIILNNMFQRTDYYKKKTIPEVTYYDIRKWLELDETIQFKGLNYDPNEELKKIEKKPFINLKAFYEINKVVANYSERTNETFSTLDYDGIGYALTVYKTDKDIRSYLKSSHNLPKRCYDDQLIEELLSLSYTKFGHLSLKAINHVLSIMQKGNTYKEAVDQLGYDTSGLKKEKRSKFLPPISDEITNPIVKRALTQARKVVNAIIRRHGSPHSVHIELARELSKNHDERTKIVSAQDENYKKNKGAISILSEHGILNPTGYDIVRYKLWKEQGERCAYSLKEIPADTFFNELKKERNGAPILEVDHILPYSQSFIDSYHNKVLVYSDENRKKGNRIPYTYFLETNKDWEAFERYVRSNKFFSKKKREYLLKRAYLPRESELIKERHLNDTRYASTFLKNFIEQNLQFKEAEDNPRKRRVQTVNGVITAHFRKRWGLEKDRQETYLHHAMDAIIVACTDHHMVTRVTEYYQIKESNKSVKKPYFPMPWEGFRDELLSHLASQPIAKKISEELKAGYQSLDYIFVSRMPKRSITGAAHKQTIMRKGGIDKKGKTIIIERLHLKDIKFDENGDFKMVGKEQDMATYEAIKQRYLEHGKNSKKAFETPLYKPSKKGTGNLIKRVKVEGQAKSFVREVNGGVAQNGDLVRVDLFEKDDKYYMVPIYVPDTVCSELPKKVVASSKGYEQWLTLDNSFTFKFSLYPYDLVRLVKGDEDRFLYFGTLDIDSDRLNFKDVNKPSKKNEYRYSLKTIEDLEKYEVGVLGDLRLVRKETRRNFHSGGSKRPAATKKAGQAKKKK

SEQ ID NO: 514 - protein, 1324 aa, Artificial Sequence
  source: /note="Description of Artificial Sequence: Synthetic polypeptide"
  source: /note="LPG50166-nAPG07433.1  protein sequence"
MAPKKKRKVDYKDHDGDYKDHDIDYKDDDDKMSDNELNHEYWMRHALTLAQRARDEGEVPVGAVLVLNNQVIGEGWNRAIGLHDPTAHAEIMALRQGGMVLQNYRLIDATLYVTFEPCIMCAGAMVHSRIGQVVFGVRNSKRGAAGSLINILNYPGMNHRVDVTEGVLSERCANMLCDFYREPRLQFNAQRKAEKAGNAAASGGSSGGSSGSETPGTSESATPESSGGSSGGSMRELDYRIGLAIGTNSIGWGVIELSWNKDRERYEKVRIVDQGVRMFDRAEMPKTGASLAEPRRIARSSRRRLNRKSQRKKNIRNLLVQHGVITQEELDSLYPLSKKSMDIWGIRLDGLDRLLNHFEWARLLIHLAQRRGFKSNRKSELKDTETGKVLSSIQLNEKRLSLYRTVGEMWMKDPDFSKYDRKRNSPNEYVFSVSRAELEKEIVTLFAAQRRFQSPYASKDLQETYLQIWTHQLPFASGNAILNKVGYCSLLKGKERRIPKATYTFQYFSALDQVNRTRLGPDFQPFTKEQREIILNNMFQRTDYYKKKTIPEVTYYDIRKWLELDETIQFKGLNYDPNEELKKIEKKPFINLKAFYEINKVVANYSERTNETFSTLDYDGIGYALTVYKTDKDIRSYLKSSHNLPKRCYDDQLIEELLSLSYTKFGHLSLKAINHVLSIMQKGNTYKEAVDQLGYDTSGLKKEKRSKFLPPISDEITNPIVKRALTQARKVVNAIIRRHGSPHSVHIELARELSKNHDERTKIVSAQDENYKKNKGAISILSEHGILNPTGYDIVRYKLWKEQGERCAYSLKEIPADTFFNELKKERNGAPILEVDHILPYSQSFIDSYHNKVLVYSDENRKKGNRIPYTYFLETNKDWEAFERYVRSNKFFSKKKREYLLKRAYLPRESELIKERHLNDTRYASTFLKNFIEQNLQFKEAEDNPRKRRVQTVNGVITAHFRKRWGLEKDRQETYLHHAMDAIIVACTDHHMVTRVTEYYQIKESNKSVKKPYFPMPWEGFRDELLSHLASQPIAKKISEELKAGYQSLDYIFVSRMPKRSITGAAHKQTIMRKGGIDKKGKTIIIERLHLKDIKFDENGDFKMVGKEQDMATYEAIKQRYLEHGKNSKKAFETPLYKPSKKGTGNLIKRVKVEGQAKSFVREVNGGVAQNGDLVRVDLFEKDDKYYMVPIYVPDTVCSELPKKVVASSKGYEQWLTLDNSFTFKFSLYPYDLVRLVKGDEDRFLYFGTLDIDSDRLNFKDVNKPSKKNEYRYSLKTIEDLEKYEVGVLGDLRLVRKETRRNFHSGGSKRPAATKKAGQAKKKK

SEQ ID NO: 515 - protein, 1323 aa, Artificial Sequence
  source: /note="Description of Artificial Sequence: Synthetic polypeptide"
  source: /note="LPG50167-nAPG07433.1  protein sequence"
MAPKKKRKVDYKDHDGDYKDHDIDYKDDDDKMSNPELTHDHWMRHALTLAQRARNEGEVPVGAVLVLNGQVIGEGWNRAIGLHDPTAHAEIMALRQGGLVLQNYRLIDTVLYVTFEPCVMCAGAMVHSRIGQLVFGVRNSKRGAAGSLINVLNYPGMNHRVEIIEGVLRDECAAMLCDFYRHPRLVKNALKKNAGTSPTQSGGSSGGSSGSETPGTSESATPESSGGSSGGSMRELDYRIGLAIGTNSIGWGVIELSWNKDRERYEKVRIVDQGVRMFDRAEMPKTGASLAEPRRIARSSRRRLNRKSQRKKNIRNLLVQHGVITQEELDSLYPLSKKSMDIWGIRLDGLDRLLNHFEWARLLIHLAQRRGFKSNRKSELKDTETGKVLSSIQLNEKRLSLYRTVGEMWMKDPDFSKYDRKRNSPNEYVFSVSRAELEKEIVTLFAAQRRFQSPYASKDLQETYLQIWTHQLPFASGNAILNKVGYCSLLKGKERRIPKATYTFQYFSALDQVNRTRLGPDFQPFTKEQREIILNNMFQRTDYYKKKTIPEVTYYDIRKWLELDETIQFKGLNYDPNEELKKIEKKPFINLKAFYEINKVVANYSERTNETFSTLDYDGIGYALTVYKTDKDIRSYLKSSHNLPKRCYDDQLIEELLSLSYTKFGHLSLKAINHVLSIMQKGNTYKEAVDQLGYDTSGLKKEKRSKFLPPISDEITNPIVKRALTQARKVVNAIIRRHGSPHSVHIELARELSKNHDERTKIVSAQDENYKKNKGAISILSEHGILNPTGYDIVRYKLWKEQGERCAYSLKEIPADTFFNELKKERNGAPILEVDHILPYSQSFIDSYHNKVLVYSDENRKKGNRIPYTYFLETNKDWEAFERYVRSNKFFSKKKREYLLKRAYLPRESELIKERHLNDTRYASTFLKNFIEQNLQFKEAEDNPRKRRVQTVNGVITAHFRKRWGLEKDRQETYLHHAMDAIIVACTDHHMVTRVTEYYQIKESNKSVKKPYFPMPWEGFRDELLSHLASQPIAKKISEELKAGYQSLDYIFVSRMPKRSITGAAHKQTIMRKGGIDKKGKTIIIERLHLKDIKFDENGDFKMVGKEQDMATYEAIKQRYLEHGKNSKKAFETPLYKPSKKGTGNLIKRVKVEGQAKSFVREVNGGVAQNGDLVRVDLFEKDDKYYMVPIYVPDTVCSELPKKVVASSKGYEQWLTLDNSFTFKFSLYPYDLVRLVKGDEDRFLYFGTLDIDSDRLNFKDVNKPSKKNEYRYSLKTIEDLEKYEVGVLGDLRLVRKETRRNFHSGGSKRPAATKKAGQAKKKK

SEQ ID NO: 516 - protein, 1320 aa, Artificial Sequence
  source: /note="Description of Artificial Sequence: Synthetic polypeptide"
  source: /note="LPG50168-nAPG07433.1  protein sequence"
MAPKKKRKVDYKDHDGDYKDHDIDYKDDDDKMSDTELNHEYWMRHALMLAKRARDEGEVPVGAVLVLKNQVIGEGWNRAIGLHDPTAHAEIMALRQGGLVLQNYRLIDTTLYVTFEPCVMCAGAMVHSRIGNLVFGVRNSKRGAAGSLINVLNYPGMNHRVEIAEGVLADECSAMLCDFYRHPRQQQNALKQAAKHDSGGSSGGSSGSETPGTSESATPESSGGSSGGSMRELDYRIGLAIGTNSIGWGVIELSWNKDRERYEKVRIVDQGVRMFDRAEMPKTGASLAEPRRIARSSRRRLNRKSQRKKNIRNLLVQHGVITQEELDSLYPLSKKSMDIWGIRLDGLDRLLNHFEWARLLIHLAQRRGFKSNRKSELKDTETGKVLSSIQLNEKRLSLYRTVGEMWMKDPDFSKYDRKRNSPNEYVFSVSRAELEKEIVTLFAAQRRFQSPYASKDLQETYLQIWTHQLPFASGNAILNKVGYCSLLKGKERRIPKATYTFQYFSALDQVNRTRLGPDFQPFTKEQREIILNNMFQRTDYYKKKTIPEVTYYDIRKWLELDETIQFKGLNYDPNEELKKIEKKPFINLKAFYEINKVVANYSERTNETFSTLDYDGIGYALTVYKTDKDIRSYLKSSHNLPKRCYDDQLIEELLSLSYTKFGHLSLKAINHVLSIMQKGNTYKEAVDQLGYDTSGLKKEKRSKFLPPISDEITNPIVKRALTQARKVVNAIIRRHGSPHSVHIELARELSKNHDERTKIVSAQDENYKKNKGAISILSEHGILNPTGYDIVRYKLWKEQGERCAYSLKEIPADTFFNELKKERNGAPILEVDHILPYSQSFIDSYHNKVLVYSDENRKKGNRIPYTYFLETNKDWEAFERYVRSNKFFSKKKREYLLKRAYLPRESELIKERHLNDTRYASTFLKNFIEQNLQFKEAEDNPRKRRVQTVNGVITAHFRKRWGLEKDRQETYLHHAMDAIIVACTDHHMVTRVTEYYQIKESNKSVKKPYFPMPWEGFRDELLSHLASQPIAKKISEELKAGYQSLDYIFVSRMPKRSITGAAHKQTIMRKGGIDKKGKTIIIERLHLKDIKFDENGDFKMVGKEQDMATYEAIKQRYLEHGKNSKKAFETPLYKPSKKGTGNLIKRVKVEGQAKSFVREVNGGVAQNGDLVRVDLFEKDDKYYMVPIYVPDTVCSELPKKVVASSKGYEQWLTLDNSFTFKFSLYPYDLVRLVKGDEDRFLYFGTLDIDSDRLNFKDVNKPSKKNEYRYSLKTIEDLEKYEVGVLGDLRLVRKETRRNFHSGGSKRPAATKKAGQAKKKK

SEQ ID NO: 517 - protein, 1325 aa, Artificial Sequence
  source: /note="Description of Artificial Sequence: Synthetic polypeptide"
  source: /note="LPG50169-nAPG07433.1  protein sequence"
MAPKKKRKVDYKDHDGDYKDHDIDYKDDDDKMSDIELNHEYWMRHALMLAKRAREEGEVPVGAVLVLNNQVIGEGWNRAIGLHDPTAHAEIMALRQGGLVLQNYRLIDTTLYVTFEPCVMCAGAMVHSRIGHLVFGVRNSKRGAAGSLINVLNYPGMNHRIEFTEGVLADECSGMLCDFYRYPRQQQNTLKQAAKANPPAAQSGGSSGGSSGSETPGTSESATPESSGGSSGGSMRELDYRIGLAIGTNSIGWGVIELSWNKDRERYEKVRIVDQGVRMFDRAEMPKTGASLAEPRRIARSSRRRLNRKSQRKKNIRNLLVQHGVITQEELDSLYPLSKKSMDIWGIRLDGLDRLLNHFEWARLLIHLAQRRGFKSNRKSELKDTETGKVLSSIQLNEKRLSLYRTVGEMWMKDPDFSKYDRKRNSPNEYVFSVSRAELEKEIVTLFAAQRRFQSPYASKDLQETYLQIWTHQLPFASGNAILNKVGYCSLLKGKERRIPKATYTFQYFSALDQVNRTRLGPDFQPFTKEQREIILNNMFQRTDYYKKKTIPEVTYYDIRKWLELDETIQFKGLNYDPNEELKKIEKKPFINLKAFYEINKVVANYSERTNETFSTLDYDGIGYALTVYKTDKDIRSYLKSSHNLPKRCYDDQLIEELLSLSYTKFGHLSLKAINHVLSIMQKGNTYKEAVDQLGYDTSGLKKEKRSKFLPPISDEITNPIVKRALTQARKVVNAIIRRHGSPHSVHIELARELSKNHDERTKIVSAQDENYKKNKGAISILSEHGILNPTGYDIVRYKLWKEQGERCAYSLKEIPADTFFNELKKERNGAPILEVDHILPYSQSFIDSYHNKVLVYSDENRKKGNRIPYTYFLETNKDWEAFERYVRSNKFFSKKKREYLLKRAYLPRESELIKERHLNDTRYASTFLKNFIEQNLQFKEAEDNPRKRRVQTVNGVITAHFRKRWGLEKDRQETYLHHAMDAIIVACTDHHMVTRVTEYYQIKESNKSVKKPYFPMPWEGFRDELLSHLASQPIAKKISEELKAGYQSLDYIFVSRMPKRSITGAAHKQTIMRKGGIDKKGKTIIIERLHLKDIKFDENGDFKMVGKEQDMATYEAIKQRYLEHGKNSKKAFETPLYKPSKKGTGNLIKRVKVEGQAKSFVREVNGGVAQNGDLVRVDLFEKDDKYYMVPIYVPDTVCSELPKKVVASSKGYEQWLTLDNSFTFKFSLYPYDLVRLVKGDEDRFLYFGTLDIDSDRLNFKDVNKPSKKNEYRYSLKTIEDLEKYEVGVLGDLRLVRKETRRNFHSGGSKRPAATKKAGQAKKKK

SEQ ID NO: 518 - protein, 1319 aa, Artificial Sequence
  source: /note="Description of Artificial Sequence: Synthetic polypeptide"
  source: /note="LPG50170-nAPG07433.1  protein sequence"
MAPKKKRKVDYKDHDGDYKDHDIDYKDDDDKMSDNELNHERWMRHALTLAQRARDEGEVPVGAVLVYQNQVIGEGWNRAIGLHDPTAHAEIMALRQGGLVLQNYRLIDTTLYVTFEPCVMCAGAMVHSRIGQLVFGVRNSKRGAAGSLINVLNYPGMNHRVAITEGVLAESCSAMLCDFYRHPREQKNALRRAAQSSGGSSGGSSGSETPGTSESATPESSGGSSGGSMRELDYRIGLAIGTNSIGWGVIELSWNKDRERYEKVRIVDQGVRMFDRAEMPKTGASLAEPRRIARSSRRRLNRKSQRKKNIRNLLVQHGVITQEELDSLYPLSKKSMDIWGIRLDGLDRLLNHFEWARLLIHLAQRRGFKSNRKSELKDTETGKVLSSIQLNEKRLSLYRTVGEMWMKDPDFSKYDRKRNSPNEYVFSVSRAELEKEIVTLFAAQRRFQSPYASKDLQETYLQIWTHQLPFASGNAILNKVGYCSLLKGKERRIPKATYTFQYFSALDQVNRTRLGPDFQPFTKEQREIILNNMFQRTDYYKKKTIPEVTYYDIRKWLELDETIQFKGLNYDPNEELKKIEKKPFINLKAFYEINKVVANYSERTNETFSTLDYDGIGYALTVYKTDKDIRSYLKSSHNLPKRCYDDQLIEELLSLSYTKFGHLSLKAINHVLSIMQKGNTYKEAVDQLGYDTSGLKKEKRSKFLPPISDEITNPIVKRALTQARKVVNAIIRRHGSPHSVHIELARELSKNHDERTKIVSAQDENYKKNKGAISILSEHGILNPTGYDIVRYKLWKEQGERCAYSLKEIPADTFFNELKKERNGAPILEVDHILPYSQSFIDSYHNKVLVYSDENRKKGNRIPYTYFLETNKDWEAFERYVRSNKFFSKKKREYLLKRAYLPRESELIKERHLNDTRYASTFLKNFIEQNLQFKEAEDNPRKRRVQTVNGVITAHFRKRWGLEKDRQETYLHHAMDAIIVACTDHHMVTRVTEYYQIKESNKSVKKPYFPMPWEGFRDELLSHLASQPIAKKISEELKAGYQSLDYIFVSRMPKRSITGAAHKQTIMRKGGIDKKGKTIIIERLHLKDIKFDENGDFKMVGKEQDMATYEAIKQRYLEHGKNSKKAFETPLYKPSKKGTGNLIKRVKVEGQAKSFVREVNGGVAQNGDLVRVDLFEKDDKYYMVPIYVPDTVCSELPKKVVASSKGYEQWLTLDNSFTFKFSLYPYDLVRLVKGDEDRFLYFGTLDIDSDRLNFKDVNKPSKKNEYRYSLKTIEDLEKYEVGVLGDLRLVRKETRRNFHSGGSKRPAATKKAGQAKKKK

SEQ ID NO: 519 - protein, 1320 aa, Artificial Sequence
  source: /note="Description of Artificial Sequence: Synthetic polypeptide"
  source: /note="LPG50171-nAPG07433.1  protein sequence"
MAPKKKRKVDYKDHDGDYKDHDIDYKDDDDKMSDLELNDEYWMRHALTLAKRAREEGEVPVGAVLVLNNQVIGEGWNRAIGLHDPTAHAEIMALRQGGLVLQNYRLIDATLYVTFEPCVMCAGAMVHSRIARLVFGVRNSKRGAAGSLMNVLNYPGMNHRVEISEGVLAESCSAMLCDFYRWPREVKNALKKAREQNSGGSSGGSSGSETPGTSESATPESSGGSSGGSMRELDYRIGLAIGTNSIGWGVIELSWNKDRERYEKVRIVDQGVRMFDRAEMPKTGASLAEPRRIARSSRRRLNRKSQRKKNIRNLLVQHGVITQEELDSLYPLSKKSMDIWGIRLDGLDRLLNHFEWARLLIHLAQRRGFKSNRKSELKDTETGKVLSSIQLNEKRLSLYRTVGEMWMKDPDFSKYDRKRNSPNEYVFSVSRAELEKEIVTLFAAQRRFQSPYASKDLQETYLQIWTHQLPFASGNAILNKVGYCSLLKGKERRIPKATYTFQYFSALDQVNRTRLGPDFQPFTKEQREIILNNMFQRTDYYKKKTIPEVTYYDIRKWLELDETIQFKGLNYDPNEELKKIEKKPFINLKAFYEINKVVANYSERTNETFSTLDYDGIGYALTVYKTDKDIRSYLKSSHNLPKRCYDDQLIEELLSLSYTKFGHLSLKAINHVLSIMQKGNTYKEAVDQLGYDTSGLKKEKRSKFLPPISDEITNPIVKRALTQARKVVNAIIRRHGSPHSVHIELARELSKNHDERTKIVSAQDENYKKNKGAISILSEHGILNPTGYDIVRYKLWKEQGERCAYSLKEIPADTFFNELKKERNGAPILEVDHILPYSQSFIDSYHNKVLVYSDENRKKGNRIPYTYFLETNKDWEAFERYVRSNKFFSKKKREYLLKRAYLPRESELIKERHLNDTRYASTFLKNFIEQNLQFKEAEDNPRKRRVQTVNGVITAHFRKRWGLEKDRQETYLHHAMDAIIVACTDHHMVTRVTEYYQIKESNKSVKKPYFPMPWEGFRDELLSHLASQPIAKKISEELKAGYQSLDYIFVSRMPKRSITGAAHKQTIMRKGGIDKKGKTIIIERLHLKDIKFDENGDFKMVGKEQDMATYEAIKQRYLEHGKNSKKAFETPLYKPSKKGTGNLIKRVKVEGQAKSFVREVNGGVAQNGDLVRVDLFEKDDKYYMVPIYVPDTVCSELPKKVVASSKGYEQWLTLDNSFTFKFSLYPYDLVRLVKGDEDRFLYFGTLDIDSDRLNFKDVNKPSKKNEYRYSLKTIEDLEKYEVGVLGDLRLVRKETRRNFHSGGSKRPAATKKAGQAKKKK

SEQ ID NO: 520 - protein, 1323 aa, Artificial Sequence
  source: /note="Description of Artificial Sequence: Synthetic polypeptide"
  source: /note="LPG50172-nAPG07433.1  protein sequence"
MAPKKKRKVDYKDHDGDYKDHDIDYKDDDDKMSDLELDHEYWMRHALLLAKRARDEGEVPVGAVLVLNNQVIGEGWNRAIGLHDPTAHAEIMALRQGGLVLQNYRLLDTTLYVTFEPCVMCSGAMVHSRIGTLVYGVRNEKRGAAGSLMNVLGYPGMNHQVQVIDGVLAPECSGLLCDFYRMPRQQKNQQKAESTSSRGDSGGSSGGSSGSETPGTSESATPESSGGSSGGSMRELDYRIGLAIGTNSIGWGVIELSWNKDRERYEKVRIVDQGVRMFDRAEMPKTGASLAEPRRIARSSRRRLNRKSQRKKNIRNLLVQHGVITQEELDSLYPLSKKSMDIWGIRLDGLDRLLNHFEWARLLIHLAQRRGFKSNRKSELKDTETGKVLSSIQLNEKRLSLYRTVGEMWMKDPDFSKYDRKRNSPNEYVFSVSRAELEKEIVTLFAAQRRFQSPYASKDLQETYLQIWTHQLPFASGNAILNKVGYCSLLKGKERRIPKATYTFQYFSALDQVNRTRLGPDFQPFTKEQREIILNNMFQRTDYYKKKTIPEVTYYDIRKWLELDETIQFKGLNYDPNEELKKIEKKPFINLKAFYEINKVVANYSERTNETFSTLDYDGIGYALTVYKTDKDIRSYLKSSHNLPKRCYDDQLIEELLSLSYTKFGHLSLKAINHVLSIMQKGNTYKEAVDQLGYDTSGLKKEKRSKFLPPISDEITNPIVKRALTQARKVVNAIIRRHGSPHSVHIELARELSKNHDERTKIVSAQDENYKKNKGAISILSEHGILNPTGYDIVRYKLWKEQGERCAYSLKEIPADTFFNELKKERNGAPILEVDHILPYSQSFIDSYHNKVLVYSDENRKKGNRIPYTYFLETNKDWEAFERYVRSNKFFSKKKREYLLKRAYLPRESELIKERHLNDTRYASTFLKNFIEQNLQFKEAEDNPRKRRVQTVNGVITAHFRKRWGLEKDRQETYLHHAMDAIIVACTDHHMVTRVTEYYQIKESNKSVKKPYFPMPWEGFRDELLSHLASQPIAKKISEELKAGYQSLDYIFVSRMPKRSITGAAHKQTIMRKGGIDKKGKTIIIERLHLKDIKFDENGDFKMVGKEQDMATYEAIKQRYLEHGKNSKKAFETPLYKPSKKGTGNLIKRVKVEGQAKSFVREVNGGVAQNGDLVRVDLFEKDDKYYMVPIYVPDTVCSELPKKVVASSKGYEQWLTLDNSFTFKFSLYPYDLVRLVKGDEDRFLYFGTLDIDSDRLNFKDVNKPSKKNEYRYSLKTIEDLEKYEVGVLGDLRLVRKETRRNFHSGGSKRPAATKKAGQAKKKK

SEQ ID NO: 521 - protein, 1316 aa, Artificial Sequence
  source: /note="Description of Artificial Sequence: Synthetic polypeptide"
  source: /note="LPG50173-nAPG07433.1  protein sequence"
MAPKKKRKVDYKDHDGDYKDHDIDYKDDDDKMSDTELTHEYWMRHALMLAQRARDEGEVPVGAVLVLNNRVIGEGWNRAIGLHDPTAHAEIMALRQGGLVLQNYRLLDTTLYVTFEPCVMCAGAMVHGRIGTLVFGVRNLKRGAAGSLMNVLNYPGMNHRVEIVEGTLSDECSGMLCEFYRQPRLAFNAQKQASGGSSGGSSGSETPGTSESATPESSGGSSGGSMRELDYRIGLAIGTNSIGWGVIELSWNKDRERYEKVRIVDQGVRMFDRAEMPKTGASLAEPRRIARSSRRRLNRKSQRKKNIRNLLVQHGVITQEELDSLYPLSKKSMDIWGIRLDGLDRLLNHFEWARLLIHLAQRRGFKSNRKSELKDTETGKVLSSIQLNEKRLSLYRTVGEMWMKDPDFSKYDRKRNSPNEYVFSVSRAELEKEIVTLFAAQRRFQSPYASKDLQETYLQIWTHQLPFASGNAILNKVGYCSLLKGKERRIPKATYTFQYFSALDQVNRTRLGPDFQPFTKEQREIILNNMFQRTDYYKKKTIPEVTYYDIRKWLELDETIQFKGLNYDPNEELKKIEKKPFINLKAFYEINKVVANYSERTNETFSTLDYDGIGYALTVYKTDKDIRSYLKSSHNLPKRCYDDQLIEELLSLSYTKFGHLSLKAINHVLSIMQKGNTYKEAVDQLGYDTSGLKKEKRSKFLPPISDEITNPIVKRALTQARKVVNAIIRRHGSPHSVHIELARELSKNHDERTKIVSAQDENYKKNKGAISILSEHGILNPTGYDIVRYKLWKEQGERCAYSLKEIPADTFFNELKKERNGAPILEVDHILPYSQSFIDSYHNKVLVYSDENRKKGNRIPYTYFLETNKDWEAFERYVRSNKFFSKKKREYLLKRAYLPRESELIKERHLNDTRYASTFLKNFIEQNLQFKEAEDNPRKRRVQTVNGVITAHFRKRWGLEKDRQETYLHHAMDAIIVACTDHHMVTRVTEYYQIKESNKSVKKPYFPMPWEGFRDELLSHLASQPIAKKISEELKAGYQSLDYIFVSRMPKRSITGAAHKQTIMRKGGIDKKGKTIIIERLHLKDIKFDENGDFKMVGKEQDMATYEAIKQRYLEHGKNSKKAFETPLYKPSKKGTGNLIKRVKVEGQAKSFVREVNGGVAQNGDLVRVDLFEKDDKYYMVPIYVPDTVCSELPKKVVASSKGYEQWLTLDNSFTFKFSLYPYDLVRLVKGDEDRFLYFGTLDIDSDRLNFKDVNKPSKKNEYRYSLKTIEDLEKYEVGVLGDLRLVRKETRRNFHSGGSKRPAATKKAGQAKKKK

SEQ ID NO: 522 - protein, 1327 aa, Artificial Sequence
  source: /note="Description of Artificial Sequence: Synthetic polypeptide"
  source: /note="LPG50174-nAPG07433.1  protein sequence"
MAPKKKRKVDYKDHDGDYKDHDIDYKDDDDKMSIPELNHDVWMRHALTLAKRAREEGEVPVGAVLVLNGQVIGEGWNRAIGLHDPTAHAEIMALRQGGLVLQNYRLIDTTLYVTFEPCVMCAGAMVHSRIGQLVFGVRNSKRGAAGSLMNVLNYPGMNHRVEITEGVLRDECAAMLCDFYRQPRLVKNALKKPAGDPSALQNNRSGGSSGGSSGSETPGTSESATPESSGGSSGGSMRELDYRIGLAIGTNSIGWGVIELSWNKDRERYEKVRIVDQGVRMFDRAEMPKTGASLAEPRRIARSSRRRLNRKSQRKKNIRNLLVQHGVITQEELDSLYPLSKKSMDIWGIRLDGLDRLLNHFEWARLLIHLAQRRGFKSNRKSELKDTETGKVLSSIQLNEKRLSLYRTVGEMWMKDPDFSKYDRKRNSPNEYVFSVSRAELEKEIVTLFAAQRRFQSPYASKDLQETYLQIWTHQLPFASGNAILNKVGYCSLLKGKERRIPKATYTFQYFSALDQVNRTRLGPDFQPFTKEQREIILNNMFQRTDYYKKKTIPEVTYYDIRKWLELDETIQFKGLNYDPNEELKKIEKKPFINLKAFYEINKVVANYSERTNETFSTLDYDGIGYALTVYKTDKDIRSYLKSSHNLPKRCYDDQLIEELLSLSYTKFGHLSLKAINHVLSIMQKGNTYKEAVDQLGYDTSGLKKEKRSKFLPPISDEITNPIVKRALTQARKVVNAIIRRHGSPHSVHIELARELSKNHDERTKIVSAQDENYKKNKGAISILSEHGILNPTGYDIVRYKLWKEQGERCAYSLKEIPADTFFNELKKERNGAPILEVDHILPYSQSFIDSYHNKVLVYSDENRKKGNRIPYTYFLETNKDWEAFERYVRSNKFFSKKKREYLLKRAYLPRESELIKERHLNDTRYASTFLKNFIEQNLQFKEAEDNPRKRRVQTVNGVITAHFRKRWGLEKDRQETYLHHAMDAIIVACTDHHMVTRVTEYYQIKESNKSVKKPYFPMPWEGFRDELLSHLASQPIAKKISEELKAGYQSLDYIFVSRMPKRSITGAAHKQTIMRKGGIDKKGKTIIIERLHLKDIKFDENGDFKMVGKEQDMATYEAIKQRYLEHGKNSKKAFETPLYKPSKKGTGNLIKRVKVEGQAKSFVREVNGGVAQNGDLVRVDLFEKDDKYYMVPIYVPDTVCSELPKKVVASSKGYEQWLTLDNSFTFKFSLYPYDLVRLVKGDEDRFLYFGTLDIDSDRLNFKDVNKPSKKNEYRYSLKTIEDLEKYEVGVLGDLRLVRKETRRNFHSGGSKRPAATKKAGQAKKKK

SEQ ID NO: 523 - protein, 1320 aa, Artificial Sequence
  source: /note="Description of Artificial Sequence: Synthetic polypeptide"
  source: /note="LPG50175-nAPG07433.1  protein sequence"
MAPKKKRKVDYKDHDGDYKDHDIDYKDDDDKMSDLELNDEYWMRHALTLAKRAREEGEVPVGAVLVLNNQVIGEGWNRAIGLHDPTAHAEIMALRQGGLVLQNYRLIDATLYVTFEPCVMCAGAMVHSRIARLVFGVRNSKRGAAGSLMNVLNYPGMNHRVEISEGVLAGSCSAMLCDFYRWPREVKNALKKAREQNSGGSSGGSSGSETPGTSESATPESSGGSSGGSMRELDYRIGLAIGTNSIGWGVIELSWNKDRERYEKVRIVDQGVRMFDRAEMPKTGASLAEPRRIARSSRRRLNRKSQRKKNIRNLLVQHGVITQEELDSLYPLSKKSMDIWGIRLDGLDRLLNHFEWARLLIHLAQRRGFKSNRKSELKDTETGKVLSSIQLNEKRLSLYRTVGEMWMKDPDFSKYDRKRNSPNEYVFSVSRAELEKEIVTLFAAQRRFQSPYASKDLQETYLQIWTHQLPFASGNAILNKVGYCSLLKGKERRIPKATYTFQYFSALDQVNRTRLGPDFQPFTKEQREIILNNMFQRTDYYKKKTIPEVTYYDIRKWLELDETIQFKGLNYDPNEELKKIEKKPFINLKAFYEINKVVANYSERTNETFSTLDYDGIGYALTVYKTDKDIRSYLKSSHNLPKRCYDDQLIEELLSLSYTKFGHLSLKAINHVLSIMQKGNTYKEAVDQLGYDTSGLKKEKRSKFLPPISDEITNPIVKRALTQARKVVNAIIRRHGSPHSVHIELARELSKNHDERTKIVSAQDENYKKNKGAISILSEHGILNPTGYDIVRYKLWKEQGERCAYSLKEIPADTFFNELKKERNGAPILEVDHILPYSQSFIDSYHNKVLVYSDENRKKGNRIPYTYFLETNKDWEAFERYVRSNKFFSKKKREYLLKRAYLPRESELIKERHLNDTRYASTFLKNFIEQNLQFKEAEDNPRKRRVQTVNGVITAHFRKRWGLEKDRQETYLHHAMDAIIVACTDHHMVTRVTEYYQIKESNKSVKKPYFPMPWEGFRDELLSHLASQPIAKKISEELKAGYQSLDYIFVSRMPKRSITGAAHKQTIMRKGGIDKKGKTIIIERLHLKDIKFDENGDFKMVGKEQDMATYEAIKQRYLEHGKNSKKAFETPLYKPSKKGTGNLIKRVKVEGQAKSFVREVNGGVAQNGDLVRVDLFEKDDKYYMVPIYVPDTVCSELPKKVVASSKGYEQWLTLDNSFTFKFSLYPYDLVRLVKGDEDRFLYFGTLDIDSDRLNFKDVNKPSKKNEYRYSLKTIEDLEKYEVGVLGDLRLVRKETRRNFHSGGSKRPAATKKAGQAKKKK

SEQ ID NO: 524 - protein, 1307 aa, Artificial Sequence
  source: /note="Description of Artificial Sequence: Synthetic polypeptide"
  source: /note="LPG50176-nAPG07433.1  protein sequence"
MAPKKKRKVDYKDHDGDYKDHDIDYKDDDDKMSDIEQNHEYWMRHALVLAKRAREEGEVPVGAVLVLNNQVIGEGWNRAIGLHDPTAHAEIMALRQGGLVLQNYRLIDTTLYVTFEPCVMCAGAMVHGRIGSLVFGVRNSKRGAAGSLINVLNYPGMNHRVEMTEGVLADECSAMLCDFYRHPRSGGSSGGSSGSETPGTSESATPESSGGSSGGSMRELDYRIGLAIGTNSIGWGVIELSWNKDRERYEKVRIVDQGVRMFDRAEMPKTGASLAEPRRIARSSRRRLNRKSQRKKNIRNLLVQHGVITQEELDSLYPLSKKSMDIWGIRLDGLDRLLNHFEWARLLIHLAQRRGFKSNRKSELKDTETGKVLSSIQLNEKRLSLYRTVGEMWMKDPDFSKYDRKRNSPNEYVFSVSRAELEKEIVTLFAAQRRFQSPYASKDLQETYLQIWTHQLPFASGNAILNKVGYCSLLKGKERRIPKATYTFQYFSALDQVNRTRLGPDFQPFTKEQREIILNNMFQRTDYYKKKTIPEVTYYDIRKWLELDETIQFKGLNYDPNEELKKIEKKPFINLKAFYEINKVVANYSERTNETFSTLDYDGIGYALTVYKTDKDIRSYLKSSHNLPKRCYDDQLIEELLSLSYTKFGHLSLKAINHVLSIMQKGNTYKEAVDQLGYDTSGLKKEKRSKFLPPISDEITNPIVKRALTQARKVVNAIIRRHGSPHSVHIELARELSKNHDERTKIVSAQDENYKKNKGAISILSEHGILNPTGYDIVRYKLWKEQGERCAYSLKEIPADTFFNELKKERNGAPILEVDHILPYSQSFIDSYHNKVLVYSDENRKKGNRIPYTYFLETNKDWEAFERYVRSNKFFSKKKREYLLKRAYLPRESELIKERHLNDTRYASTFLKNFIEQNLQFKEAEDNPRKRRVQTVNGVITAHFRKRWGLEKDRQETYLHHAMDAIIVACTDHHMVTRVTEYYQIKESNKSVKKPYFPMPWEGFRDELLSHLASQPIAKKISEELKAGYQSLDYIFVSRMPKRSITGAAHKQTIMRKGGIDKKGKTIIIERLHLKDIKFDENGDFKMVGKEQDMATYEAIKQRYLEHGKNSKKAFETPLYKPSKKGTGNLIKRVKVEGQAKSFVREVNGGVAQNGDLVRVDLFEKDDKYYMVPIYVPDTVCSELPKKVVASSKGYEQWLTLDNSFTFKFSLYPYDLVRLVKGDEDRFLYFGTLDIDSDRLNFKDVNKPSKKNEYRYSLKTIEDLEKYEVGVLGDLRLVRKETRRNFHSGGSKRPAATKKAGQAKKKK

SEQ ID NO: 525 - protein, 1322 aa, Artificial Sequence
  source: /note="Description of Artificial Sequence: Synthetic polypeptide"
  source: /note="LPG50177-nAPG07433.1  protein sequence"
MAPKKKRKVDYKDHDGDYKDHDIDYKDDDDKMCNPERDHEYWMRHALTLAQRARDEGEVPVGAVLVLNNQVIGEGWNRAIGLHDPTAHAEIMALRQGGMVLQNYRLLDTTLYVTFEPCVMCSGAMVHSRIGTLVFGVRNEKRGAAGSLLNVLGYPGMNHQVKTIGGVLAPACSALLCDFYRMPRQQKNQQKAELKLSNDSGGSSGGSSGSETPGTSESATPESSGGSSGGSMRELDYRIGLAIGTNSIGWGVIELSWNKDRERYEKVRIVDQGVRMFDRAEMPKTGASLAEPRRIARSSRRRLNRKSQRKKNIRNLLVQHGVITQEELDSLYPLSKKSMDIWGIRLDGLDRLLNHFEWARLLIHLAQRRGFKSNRKSELKDTETGKVLSSIQLNEKRLSLYRTVGEMWMKDPDFSKYDRKRNSPNEYVFSVSRAELEKEIVTLFAAQRRFQSPYASKDLQETYLQIWTHQLPFASGNAILNKVGYCSLLKGKERRIPKATYTFQYFSALDQVNRTRLGPDFQPFTKEQREIILNNMFQRTDYYKKKTIPEVTYYDIRKWLELDETIQFKGLNYDPNEELKKIEKKPFINLKAFYEINKVVANYSERTNETFSTLDYDGIGYALTVYKTDKDIRSYLKSSHNLPKRCYDDQLIEELLSLSYTKFGHLSLKAINHVLSIMQKGNTYKEAVDQLGYDTSGLKKEKRSKFLPPISDEITNPIVKRALTQARKVVNAIIRRHGSPHSVHIELARELSKNHDERTKIVSAQDENYKKNKGAISILSEHGILNPTGYDIVRYKLWKEQGERCAYSLKEIPADTFFNELKKERNGAPILEVDHILPYSQSFIDSYHNKVLVYSDENRKKGNRIPYTYFLETNKDWEAFERYVRSNKFFSKKKREYLLKRAYLPRESELIKERHLNDTRYASTFLKNFIEQNLQFKEAEDNPRKRRVQTVNGVITAHFRKRWGLEKDRQETYLHHAMDAIIVACTDHHMVTRVTEYYQIKESNKSVKKPYFPMPWEGFRDELLSHLASQPIAKKISEELKAGYQSLDYIFVSRMPKRSITGAAHKQTIMRKGGIDKKGKTIIIERLHLKDIKFDENGDFKMVGKEQDMATYEAIKQRYLEHGKNSKKAFETPLYKPSKKGTGNLIKRVKVEGQAKSFVREVNGGVAQNGDLVRVDLFEKDDKYYMVPIYVPDTVCSELPKKVVASSKGYEQWLTLDNSFTFKFSLYPYDLVRLVKGDEDRFLYFGTLDIDSDRLNFKDVNKPSKKNEYRYSLKTIEDLEKYEVGVLGDLRLVRKETRRNFHSGGSKRPAATKKAGQAKKKK

SEQ ID NO: 526 - protein, 1316 aa, Artificial Sequence
  source: /note="Description of Artificial Sequence: Synthetic polypeptide"
  source: /note="LPG50178-nAPG07433.1  protein sequence"
MAPKKKRKVDYKDHDGDYKDHDIDYKDDDDKMSAIELNHEYWMRHALGLAQRARDEGEVPVGAVLVYQNQVIGEGWNRAIGLHDPTAHAEIMALRQGGLVLQNYRLIDTTLYVTFEPCVMCAGAMVHSRIGRVVFGVRNSKRGAAGSLMNVLNYPGMNHRVEVTEGVLAGECSAMLCDFYRAPRAQFNAQKRPSGGSSGGSSGSETPGTSESATPESSGGSSGGSMRELDYRIGLAIGTNSIGWGVIELSWNKDRERYEKVRIVDQGVRMFDRAEMPKTGASLAEPRRIARSSRRRLNRKSQRKKNIRNLLVQHGVITQEELDSLYPLSKKSMDIWGIRLDGLDRLLNHFEWARLLIHLAQRRGFKSNRKSELKDTETGKVLSSIQLNEKRLSLYRTVGEMWMKDPDFSKYDRKRNSPNEYVFSVSRAELEKEIVTLFAAQRRFQSPYASKDLQETYLQIWTHQLPFASGNAILNKVGYCSLLKGKERRIPKATYTFQYFSALDQVNRTRLGPDFQPFTKEQREIILNNMFQRTDYYKKKTIPEVTYYDIRKWLELDETIQFKGLNYDPNEELKKIEKKPFINLKAFYEINKVVANYSERTNETFSTLDYDGIGYALTVYKTDKDIRSYLKSSHNLPKRCYDDQLIEELLSLSYTKFGHLSLKAINHVLSIMQKGNTYKEAVDQLGYDTSGLKKEKRSKFLPPISDEITNPIVKRALTQARKVVNAIIRRHGSPHSVHIELARELSKNHDERTKIVSAQDENYKKNKGAISILSEHGILNPTGYDIVRYKLWKEQGERCAYSLKEIPADTFFNELKKERNGAPILEVDHILPYSQSFIDSYHNKVLVYSDENRKKGNRIPYTYFLETNKDWEAFERYVRSNKFFSKKKREYLLKRAYLPRESELIKERHLNDTRYASTFLKNFIEQNLQFKEAEDNPRKRRVQTVNGVITAHFRKRWGLEKDRQETYLHHAMDAIIVACTDHHMVTRVTEYYQIKESNKSVKKPYFPMPWEGFRDELLSHLASQPIAKKISEELKAGYQSLDYIFVSRMPKRSITGAAHKQTIMRKGGIDKKGKTIIIERLHLKDIKFDENGDFKMVGKEQDMATYEAIKQRYLEHGKNSKKAFETPLYKPSKKGTGNLIKRVKVEGQAKSFVREVNGGVAQNGDLVRVDLFEKDDKYYMVPIYVPDTVCSELPKKVVASSKGYEQWLTLDNSFTFKFSLYPYDLVRLVKGDEDRFLYFGTLDIDSDRLNFKDVNKPSKKNEYRYSLKTIEDLEKYEVGVLGDLRLVRKETRRNFHSGGSKRPAATKKAGQAKKKK

SEQ ID NO: 527 - protein, 1323 aa, Artificial Sequence
  source: /note="Description of Artificial Sequence: Synthetic polypeptide"
  source: /note="LPG50179-nAPG07433.1  protein sequence"
MAPKKKRKVDYKDHDGDYKDHDIDYKDDDDKMSNPELNHEYWMRYALTLAKRAREEGEVPVGAVLVLNERVIGEGWNRAIGLHDPTAHAEIMALRQGGMVLQNYRLIDTTLYVTFEPCVMCAGAMVHSRIGHLVFGVRNSKRGAAGSLMNVLNYPGMNHRVAITEGVLRDECAAMLCDFYRQPRQVKNALKKTLSDSQEQSGGSSGGSSGSETPGTSESATPESSGGSSGGSMRELDYRIGLAIGTNSIGWGVIELSWNKDRERYEKVRIVDQGVRMFDRAEMPKTGASLAEPRRIARSSRRRLNRKSQRKKNIRNLLVQHGVITQEELDSLYPLSKKSMDIWGIRLDGLDRLLNHFEWARLLIHLAQRRGFKSNRKSELKDTETGKVLSSIQLNEKRLSLYRTVGEMWMKDPDFSKYDRKRNSPNEYVFSVSRAELEKEIVTLFAAQRRFQSPYASKDLQETYLQIWTHQLPFASGNAILNKVGYCSLLKGKERRIPKATYTFQYFSALDQVNRTRLGPDFQPFTKEQREIILNNMFQRTDYYKKKTIPEVTYYDIRKWLELDETIQFKGLNYDPNEELKKIEKKPFINLKAFYEINKVVANYSERTNETFSTLDYDGIGYALTVYKTDKDIRSYLKSSHNLPKRCYDDQLIEELLSLSYTKFGHLSLKAINHVLSIMQKGNTYKEAVDQLGYDTSGLKKEKRSKFLPPISDEITNPIVKRALTQARKVVNAIIRRHGSPHSVHIELARELSKNHDERTKIVSAQDENYKKNKGAISILSEHGILNPTGYDIVRYKLWKEQGERCAYSLKEIPADTFFNELKKERNGAPILEVDHILPYSQSFIDSYHNKVLVYSDENRKKGNRIPYTYFLETNKDWEAFERYVRSNKFFSKKKREYLLKRAYLPRESELIKERHLNDTRYASTFLKNFIEQNLQFKEAEDNPRKRRVQTVNGVITAHFRKRWGLEKDRQETYLHHAMDAIIVACTDHHMVTRVTEYYQIKESNKSVKKPYFPMPWEGFRDELLSHLASQPIAKKISEELKAGYQSLDYIFVSRMPKRSITGAAHKQTIMRKGGIDKKGKTIIIERLHLKDIKFDENGDFKMVGKEQDMATYEAIKQRYLEHGKNSKKAFETPLYKPSKKGTGNLIKRVKVEGQAKSFVREVNGGVAQNGDLVRVDLFEKDDKYYMVPIYVPDTVCSELPKKVVASSKGYEQWLTLDNSFTFKFSLYPYDLVRLVKGDEDRFLYFGTLDIDSDRLNFKDVNKPSKKNEYRYSLKTIEDLEKYEVGVLGDLRLVRKETRRNFHSGGSKRPAATKKAGQAKKKK

SEQ ID NO: 528 - protein, 1322 aa, Artificial Sequence
  source: /note="Description of Artificial Sequence: Synthetic polypeptide"
  source: /note="LPG50180-nAPG07433.1  protein sequence"
MAPKKKRKVDYKDHDGDYKDHDIDYKDDDDKMSNPEHDHEYWMRHALNLAQRARDEGEVPVGAVLVLNNQVIGEGWNRAIGLHDPTAHAEIMALRQGGLVLQNYRLLDTTLYVTFEPCVMCSGAMVHSRIGTLVYGVRNEKRGAAGSLMNVLGYPGMNHQVNVIGGVLAQDCSARLCDFYRMPRQQKNQQRAELKAQGDSGGSSGGSSGSETPGTSESATPESSGGSSGGSMRELDYRIGLAIGTNSIGWGVIELSWNKDRERYEKVRIVDQGVRMFDRAEMPKTGASLAEPRRIARSSRRRLNRKSQRKKNIRNLLVQHGVITQEELDSLYPLSKKSMDIWGIRLDGLDRLLNHFEWARLLIHLAQRRGFKSNRKSELKDTETGKVLSSIQLNEKRLSLYRTVGEMWMKDPDFSKYDRKRNSPNEYVFSVSRAELEKEIVTLFAAQRRFQSPYASKDLQETYLQIWTHQLPFASGNAILNKVGYCSLLKGKERRIPKATYTFQYFSALDQVNRTRLGPDFQPFTKEQREIILNNMFQRTDYYKKKTIPEVTYYDIRKWLELDETIQFKGLNYDPNEELKKIEKKPFINLKAFYEINKVVANYSERTNETFSTLDYDGIGYALTVYKTDKDIRSYLKSSHNLPKRCYDDQLIEELLSLSYTKFGHLSLKAINHVLSIMQKGNTYKEAVDQLGYDTSGLKKEKRSKFLPPISDEITNPIVKRALTQARKVVNAIIRRHGSPHSVHIELARELSKNHDERTKIVSAQDENYKKNKGAISILSEHGILNPTGYDIVRYKLWKEQGERCAYSLKEIPADTFFNELKKERNGAPILEVDHILPYSQSFIDSYHNKVLVYSDENRKKGNRIPYTYFLETNKDWEAFERYVRSNKFFSKKKREYLLKRAYLPRESELIKERHLNDTRYASTFLKNFIEQNLQFKEAEDNPRKRRVQTVNGVITAHFRKRWGLEKDRQETYLHHAMDAIIVACTDHHMVTRVTEYYQIKESNKSVKKPYFPMPWEGFRDELLSHLASQPIAKKISEELKAGYQSLDYIFVSRMPKRSITGAAHKQTIMRKGGIDKKGKTIIIERLHLKDIKFDENGDFKMVGKEQDMATYEAIKQRYLEHGKNSKKAFETPLYKPSKKGTGNLIKRVKVEGQAKSFVREVNGGVAQNGDLVRVDLFEKDDKYYMVPIYVPDTVCSELPKKVVASSKGYEQWLTLDNSFTFKFSLYPYDLVRLVKGDEDRFLYFGTLDIDSDRLNFKDVNKPSKKNEYRYSLKTIEDLEKYEVGVLGDLRLVRKETRRNFHSGGSKRPAATKKAGQAKKKK

SEQ ID NO: 529 - protein, 1322 aa, Artificial Sequence
  source: /note="Description of Artificial Sequence: Synthetic polypeptide"
  source: /note="LPG50181-nAPG07433.1  protein sequence"
MAPKKKRKVDYKDHDGDYKDHDIDYKDDDDKMSDPELNHEYWMRHALQLAQRARDEGEVPVGAVLVLNNQVIGEGWNRAIGLHDPTAHAEIMALRQGGLVLQNYRLLDTTLYVTFEPCVMCSGAMIHSRIGTVVYGVRNEKRGAAGSLLNVLSYPGMNHQVKVIGEVLAPACSAMLCDFYRMPRQQKNQQKAEWKLSGESGGSSGGSSGSETPGTSESATPESSGGSSGGSMRELDYRIGLAIGTNSIGWGVIELSWNKDRERYEKVRIVDQGVRMFDRAEMPKTGASLAEPRRIARSSRRRLNRKSQRKKNIRNLLVQHGVITQEELDSLYPLSKKSMDIWGIRLDGLDRLLNHFEWARLLIHLAQRRGFKSNRKSELKDTETGKVLSSIQLNEKRLSLYRTVGEMWMKDPDFSKYDRKRNSPNEYVFSVSRAELEKEIVTLFAAQRRFQSPYASKDLQETYLQIWTHQLPFASGNAILNKVGYCSLLKGKERRIPKATYTFQYFSALDQVNRTRLGPDFQPFTKEQREIILNNMFQRTDYYKKKTIPEVTYYDIRKWLELDETIQFKGLNYDPNEELKKIEKKPFINLKAFYEINKVVANYSERTNETFSTLDYDGIGYALTVYKTDKDIRSYLKSSHNLPKRCYDDQLIEELLSLSYTKFGHLSLKAINHVLSIMQKGNTYKEAVDQLGYDTSGLKKEKRSKFLPPISDEITNPIVKRALTQARKVVNAIIRRHGSPHSVHIELARELSKNHDERTKIVSAQDENYKKNKGAISILSEHGILNPTGYDIVRYKLWKEQGERCAYSLKEIPADTFFNELKKERNGAPILEVDHILPYSQSFIDSYHNKVLVYSDENRKKGNRIPYTYFLETNKDWEAFERYVRSNKFFSKKKREYLLKRAYLPRESELIKERHLNDTRYASTFLKNFIEQNLQFKEAEDNPRKRRVQTVNGVITAHFRKRWGLEKDRQETYLHHAMDAIIVACTDHHMVTRVTEYYQIKESNKSVKKPYFPMPWEGFRDELLSHLASQPIAKKISEELKAGYQSLDYIFVSRMPKRSITGAAHKQTIMRKGGIDKKGKTIIIERLHLKDIKFDENGDFKMVGKEQDMATYEAIKQRYLEHGKNSKKAFETPLYKPSKKGTGNLIKRVKVEGQAKSFVREVNGGVAQNGDLVRVDLFEKDDKYYMVPIYVPDTVCSELPKKVVASSKGYEQWLTLDNSFTFKFSLYPYDLVRLVKGDEDRFLYFGTLDIDSDRLNFKDVNKPSKKNEYRYSLKTIEDLEKYEVGVLGDLRLVRKETRRNFHSGGSKRPAATKKAGQAKKKK

SEQ ID NO: 530 - protein, 1325 aa, Artificial Sequence
  source: /note="Description of Artificial Sequence: Synthetic polypeptide"
  source: /note="LPG50182-nAPG07433.1  protein sequence"
MAPKKKRKVDYKDHDGDYKDHDIDYKDDDDKMSNPELNHEYWMRYALTLAKRARDEGEVPVGAVLVYHDQVIGEGWNRAIGLHDPTAHAEIMALRQGGLVLQNYRLIDTTLYVTFEPCVMCAGAMVHSRIGRLVFGVRNSKRGAAGSLLNVLNYPGMNHQIDMEEGVLRDECAAMLCDFYRLPRIVKNALKQSPPDSTNLHASGGSSGGSSGSETPGTSESATPESSGGSSGGSMRELDYRIGLAIGTNSIGWGVIELSWNKDRERYEKVRIVDQGVRMFDRAEMPKTGASLAEPRRIARSSRRRLNRKSQRKKNIRNLLVQHGVITQEELDSLYPLSKKSMDIWGIRLDGLDRLLNHFEWARLLIHLAQRRGFKSNRKSELKDTETGKVLSSIQLNEKRLSLYRTVGEMWMKDPDFSKYDRKRNSPNEYVFSVSRAELEKEIVTLFAAQRRFQSPYASKDLQETYLQIWTHQLPFASGNAILNKVGYCSLLKGKERRIPKATYTFQYFSALDQVNRTRLGPDFQPFTKEQREIILNNMFQRTDYYKKKTIPEVTYYDIRKWLELDETIQFKGLNYDPNEELKKIEKKPFINLKAFYEINKVVANYSERTNETFSTLDYDGIGYALTVYKTDKDIRSYLKSSHNLPKRCYDDQLIEELLSLSYTKFGHLSLKAINHVLSIMQKGNTYKEAVDQLGYDTSGLKKEKRSKFLPPISDEITNPIVKRALTQARKVVNAIIRRHGSPHSVHIELARELSKNHDERTKIVSAQDENYKKNKGAISILSEHGILNPTGYDIVRYKLWKEQGERCAYSLKEIPADTFFNELKKERNGAPILEVDHILPYSQSFIDSYHNKVLVYSDENRKKGNRIPYTYFLETNKDWEAFERYVRSNKFFSKKKREYLLKRAYLPRESELIKERHLNDTRYASTFLKNFIEQNLQFKEAEDNPRKRRVQTVNGVITAHFRKRWGLEKDRQETYLHHAMDAIIVACTDHHMVTRVTEYYQIKESNKSVKKPYFPMPWEGFRDELLSHLASQPIAKKISEELKAGYQSLDYIFVSRMPKRSITGAAHKQTIMRKGGIDKKGKTIIIERLHLKDIKFDENGDFKMVGKEQDMATYEAIKQRYLEHGKNSKKAFETPLYKPSKKGTGNLIKRVKVEGQAKSFVREVNGGVAQNGDLVRVDLFEKDDKYYMVPIYVPDTVCSELPKKVVASSKGYEQWLTLDNSFTFKFSLYPYDLVRLVKGDEDRFLYFGTLDIDSDRLNFKDVNKPSKKNEYRYSLKTIEDLEKYEVGVLGDLRLVRKETRRNFHSGGSKRPAATKKAGQAKKKK

SEQ ID NO: 531 - RNA, 130 nt, Artificial Sequence; identical to SEQ ID NO: 30
  source: /note="Description of Artificial Sequence: Synthetic polynucleotide"
  source: /note="SGN000139"

SEQ ID NO: 532 - RNA, 130 nt, Artificial Sequence; identical to SEQ ID NO: 29
  source: /note="Description of Artificial Sequence: Synthetic polynucleotide"
  source: /note="SGN000143"

SEQ ID NO: 533 - RNA, 130 nt, Artificial Sequence; identical to SEQ ID NO: 27
  source: /note="Description of Artificial Sequence: Synthetic polynucleotide"
  source: /note="SGN000186"

SEQ ID NO: 534 - RNA, 130 nt, Artificial Sequence; identical to SEQ ID NO: 28
  source: /note="Description of Artificial Sequence: Synthetic polynucleotide"
  source: /note="SGN000194"

SEQ ID NO: 535 - RNA, 135 nt, Artificial Sequence; identical to SEQ ID NO: 26
  source: /note="Description of Artificial Sequence: Synthetic polynucleotide"
  source: /note="SGN000930"

SEQ ID NO: 536 - RNA, 130 nt, Artificial Sequence
  source: /note="Description of Artificial Sequence: Synthetic polynucleotide"
  source: /note="SGN001681"
ccgugccuugaccuacccuggucauaguuccauuaaagccaaaaguggcuuugauguuucuaugauaaggguuucgacccguggcgucggggaucgccugcccauugaaaugggcuucuccccauuuauu

SEQ ID NO: 537 - DNA, 20 bp, Artificial Sequence
  source: /note="Description of Artificial Sequence: Synthetic oligonucleotide"
  source: /note="SGN000139 target sequence"
aggttttaatggcccagcct

SEQ ID NO: 538 - DNA, 20 bp, Artificial Sequence
  source: /note="Description of Artificial Sequence: Synthetic oligonucleotide"
  source: /note="SGN000143 target sequence"
catggcagtacattagagca

SEQ ID NO: 539 - DNA, 20 bp, Artificial Sequence
  source: /note="Description of Artificial Sequence: Synthetic oligonucleotide"
  source: /note="SGN000186 target sequence"
ggacagtgcgcatctccctg

SEQ ID NO: 540 - DNA, 20 bp, Artificial Sequence
  source: /note="Description of Artificial Sequence: Synthetic oligonucleotide"
  source: /note="SGN000194 target sequence"
gccgcacagcattcaggtcg

SEQ ID NO: 541 - DNA, 25 bp, Artificial Sequence
  source: /note="Description of Artificial Sequence: Synthetic oligonucleotide"
  source: /note="SGN000930 target sequence"
gaacaactcaaatggaaatgaatat

SEQ ID NO: 542 - DNA, 20 bp, Artificial Sequence
  source: /note="Description of Artificial Sequence: Synthetic oligonucleotide"
  source: /note="SGN001681 target sequence"
ccgtgccttgacctaccctg

SEQ ID NO: 543 - DNA, 53 bp, Artificial Sequence
  source: /note="Description of Artificial Sequence: Synthetic oligonucleotide"
  source: /note="SGN000139 forward primer"
tcgtcggcagcgtcagatgtgtataagagacagcttgtagctggaggtccatc

SEQ ID NO: 544 - DNA, 52 bp, Artificial Sequence
  source: /note="Description of Artificial Sequence: Synthetic oligonucleotide"
  source: /note="SGN000143 forward primer"
tcgtcggcagcgtcagatgtgtataagagacagacatttgacgagcagcgaa

SEQ ID NO: 545 - DNA, 53 bp, Artificial Sequence
  source: /note="Description of Artificial Sequence: Synthetic oligonucleotide"
  source: /note="SGN000186 forward primer"
tcgtcggcagcgtcagatgtgtataagagacagtggcccctatgtggagatca

SEQ ID NO: 546 - DNA, 53 bp, Artificial Sequence
  source: /note="Description of Artificial Sequence: Synthetic oligonucleotide"
  source: /note="SGN000194 forward primer"
tcgtcggcagcgtcagatgtgtataagagacagatgacattcaggccacagtg

SEQ ID NO: 547 - DNA, 53 bp, Artificial Sequence
  source: /note="Description of Artificial Sequence: Synthetic oligonucleotide"
  source: /note="SGN000930 forward primer"
tcgtcggcagcgtcagatgtgtataagagacaggacagccaagaggttttgcc

SEQ ID NO: 548 - DNA, 53 bp, Artificial Sequence
  source: /note="Description of Artificial Sequence: Synthetic oligonucleotide"
  source: /note="SGN001681 forward primer"
tcgtcggcagcgtcagatgtgtataagagacagtggtggaactggacggggat

SEQ ID NO: 549 - DNA, 54 bp, Artificial Sequence
  source: /note="Description of Artificial Sequence: Synthetic oligonucleotide"
  source: /note="SGN000139 reverse primer"
gtctcgtgggctcggagatgtgtataagagacagtgttggcaaatctagtctcg

SEQ ID NO: 550 - DNA, 54 bp, Artificial Sequence
  source: /note="Description of Artificial Sequence: Synthetic oligonucleotide"
  source: /note="SGN000143 reverse primer"
gtctcgtgggctcggagatgtgtataagagacagggcccctggagaggttttaa

SEQ ID NO: 551 - DNA, 54 bp, Artificial Sequence
  source: /note="Description of Artificial Sequence: Synthetic oligonucleotide"
  source: /note="SGN000186 reverse primer"
gtctcgtgggctcggagatgtgtataagagacagggcagagctcagcctcatag

SEQ ID NO: 552 - DNA, 54 bp, Artificial Sequence
  source: /note="Description of Artificial Sequence: Synthetic oligonucleotide"
  source: /note="SGN000194 reverse primer"
gtctcgtgggctcggagatgtgtataagagacagcttcctcctattcaggccca

SEQ ID NO: 553 - DNA, 54 bp, Artificial Sequence
  source: /note="Description of Artificial Sequence: Synthetic oligonucleotide"
  source: /note="SGN000930 reverse primer"
gtctcgtgggctcggagatgtgtataagagacagctgtcccttgcagcttctgt

SEQ ID NO: 554 - DNA, 54 bp, Artificial Sequence
  source: /note="Description of Artificial Sequence: Synthetic oligonucleotide"
  source: /note="SGN001681 reverse primer"
gtctcgtgggctcggagatgtgtataagagacagcagcttgtggcccaggatgt

SEQ ID NO: 555 - protein, 1368 aa, Streptococcus pyogenes
  source: /note="Streptococcus pyogenes Cas9"
MDKKYSIGLDIGTNSVGWAVITDDYKVPSKKLKGLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENPINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKVGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKDPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 556 - protein, 1368 aa, Artificial Sequence
  source: /note="Description of Artificial Sequence: Synthetic polypeptide"
  source: /note="Streptococcus pyogenes Cas9 D10A nickase"
MDKKYSIGLAIGTNSVGWAVITDDYKVPSKKLKGLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENPINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKVGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKDPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 557 - protein, 1388 aa, Streptococcus thermophilus
  source: /note="Streptococcus thermophilus Cas9"
MTKPYSIGLDIGTNSVGWAVTTDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKAYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKKLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDVPSLEVVKKRKTFWYQLLKSKLISQRKFDNLTKAERGGLSPEDKAGFIQRQLVETRQITKHVARLLDEKFNNKKDENNRAVRTVKIITLKSTLVSQFRKDFELYKVREINDFHHAHDAYLNAVVASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFTVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 558 - protein, 1388 aa, Artificial Sequence
  source: /note="Description of Artificial Sequence: Synthetic polypeptide"
  source: /note="Streptococcus thermophilus Cas9 D10A nickase"
MTKPYSIGLAIGTNSVGWAVTTDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKAYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKKLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDVPSLEVVKKRKTFWYQLLKSKLISQRKFDNLTKAERGGLSPEDKAGFIQRQLVETRQITKHVARLLDEKFNNKKDENNRAVRTVKIITLKSTLVSQFRKDFELYKVREINDFHHAHDAYLNAVVASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFTVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 559 - protein, 1368 aa, Staphylococcus aureus [sequence omitted]

SEQ ID NO: 560 - protein, 1368 aa, Artificial Sequence
  source: /note="Description of Artificial Sequence: Synthetic polypeptide"
  source: /note="Staphylococcus aureus Cas9 D10A nickase"
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 561 - protein, 1300 aa, Francisella novicida
  source: /note="Francisella novicida Cas12a"
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 562 - DNA, 65 bp, Artificial Sequence
  source: /note="Description of Artificial Sequence: Synthetic oligonucleotide"
  source: /note="SGN001101 genetic locus"
accaaagatgatattttctttaatggtgccaggcataatccaggaaaactgagaacagaatgaaa

SEQ ID NO: 563 - DNA, 25 bp, Artificial Sequence
  source: /note="Description of Artificial Sequence: Synthetic oligonucleotide"
  source: /note="SGN001101 target sequence"
atattttctttaatggtgccaggca

SEQ ID NO: 564 - RNA, 130 nt, Artificial Sequence; identical to SEQ ID NO: 396
  source: /note="Description of Artificial Sequence: Synthetic polynucleotide"
  source: /note="SGN001101 sgRNA sequence"

That which is claimed:

1. A fusion protein comprising a Type II CRISPR-Cas protein nickase and a deaminase, wherein said deaminase comprises an amino acid sequence having at least 90% sequence identity to SEQ ID NO: 430 and has adenine deaminase activity, and wherein said nickase
   (a) is a Cas9 nickase; or
   (b) comprises an amino acid sequence having at least 95% sequence identity to SEQ ID NO: 42, 52, 53, 55-59, 61, 397, or 398.

2. The fusion protein of claim 1, wherein the nickase has the amino acid sequence of SEQ ID NO: 42, 53, 55-59, 61, 397, or 398.

3. The fusion protein of claim 1, wherein the fusion protein further comprises at least one nuclear localization signal (NLS).

4. The fusion protein of claim 1, wherein said deaminase comprises an amino acid sequence having at least 95% sequence identity to the amino acid sequence of SEQ ID NO: 430 and has adenine deaminase activity.

5. The fusion protein of claim 1, wherein said deaminase comprises the amino acid sequence of SEQ ID NO: 430, 419, or 434.

6. The fusion protein of claim 1, wherein said fusion protein comprises the amino acid sequence of SEQ ID NO: 519, 508, or 523.

7. The fusion protein of claim 1, wherein the fusion protein further comprises a protein tag or a cell penetrating domain.

8. A polypeptide having adenine deaminase activity and comprising an amino acid sequence having at least 90% sequence identity to the amino acid sequence of SEQ ID NO: 430.

9. The polypeptide of claim 8, wherein said polypeptide comprises an amino acid sequence having at least 95% sequence identity to the amino acid sequence of SEQ ID NO: 430.

10. The polypeptide of claim 8, wherein said polypeptide has the amino acid sequence of SEQ ID NO: 430, 419, or 434.

11. The polypeptide of claim 8, wherein said polypeptide further comprises at least one nuclear localization signal.

12. An adenine base editor comprising the polypeptide of claim 8 and a Type II CRISPR-Cas nickase, wherein said nickase
   (a) is a Cas9 nickase; or
   (b) comprises an amino acid sequence having at least 95% sequence identity to of SEQ ID NO: 42, 52, 53, 55-59, 61, 397, or 398.

13. The adenine base editor of claim 12, wherein the adenine base editor introduces an A>G mutation in a DNA molecule.

14. A cell comprising the fusion protein of claim 1, wherein the cell further comprises a guide RNA.

15. A system for modifying a target DNA molecule, said system comprising:
   a) the fusion protein of claim 1; and
   b) one or more guide RNAs (gRNAs) capable of hybridizing to said target DNA molecule, or one or more nucleic acids encoding the one or more gRNAs; and
wherein the one or more gRNAs are capable of forming a complex with the fusion protein in order to direct said fusion protein to bind to and modify the target DNA molecule.

16. The system of claim 15, wherein the nickase has the amino acid sequence of any one of SEQ ID NO: 42, 52, 53, 55-59, 61, 397, or 398.

* * * * *